(12) United States Patent
Helgadottir et al.

(10) Patent No.: US 8,158,362 B2
(45) Date of Patent: Apr. 17, 2012

(54) METHODS OF DIAGNOSING SUSCEPTIBILITY TO MYOCARDIAL INFARCTION AND SCREENING FOR AN LTA4H HAPLOTYPE

(75) Inventors: Anna Helgadottir, Reykjavík (IS); Hákon Hákonarson, Reykjavík (IS); Jeffrey R. Gulcher, Lake Barrington, IL (US); Mark E. Gurney, Grand Rapids, MI (US)

(73) Assignee: deCODE Genetics ehf., Reykjavik (IS)

( * ) Notice: Subject to any disclaimer, the term of this patent is extended or adjusted under 35 U.S.C. 154(b) by 1395 days.

(21) Appl. No.: 11/270,804

(22) Filed: Nov. 9, 2005

(65) Prior Publication Data
US 2007/0280917 A1    Dec. 6, 2007

Related U.S. Application Data

(63) Continuation-in-part of application No. 11/096,191, filed on Mar. 30, 2005.

(51) Int. Cl.
*C12Q 1/68* (2006.01)
*C07H 21/04* (2006.01)

(52) U.S. Cl. ............ 435/6.18; 536/23.2; 536/23.5
(58) Field of Classification Search .............. None
See application file for complete search history.

(56) References Cited

U.S. PATENT DOCUMENTS

| | | | |
|---|---|---|---|
| 3,983,140 A | 9/1976 | Endo et al. | |
| 4,231,938 A | 11/1980 | Monaghan et al. | |
| 4,346,227 A | 8/1982 | Terahara et al. | |
| 4,376,110 A | 3/1983 | David et al. | |
| 4,448,784 A | 5/1984 | Glamkowski et al. | |
| 4,450,171 A | 5/1984 | Hoffman et al. | |
| 4,499,289 A | 2/1985 | Baran et al. | |
| 4,613,610 A | 9/1986 | Wareing | |
| 4,647,576 A | 3/1987 | Hoefle et al. | |
| 4,681,893 A | 7/1987 | Roth | |
| 4,683,202 A | 7/1987 | Mullis | |
| 4,686,237 A | 8/1987 | Anderson | |
| 4,736,866 A | 4/1988 | Leder et al. | |
| 4,870,009 A | 9/1989 | Evans et al. | |

(Continued)

FOREIGN PATENT DOCUMENTS
CA    2337571    8/2002
(Continued)

OTHER PUBLICATIONS

Ioannidis, J. P.A. PLoS Medicine 2(8):696-701 (Aug. 2005).*

(Continued)

*Primary Examiner* — Diana B Johannsen
(74) *Attorney, Agent, or Firm* — Marshall, Gerstein & Borun LLP

(57) ABSTRACT

Polymorphisms in the FLAP and LTA4H gene are shown by genetic association analysis to be susceptibility markers for myocardial infarction (MI) and ACS, as well as stroke and PAOD. Pathway targeting for treatment and diagnostic applications in identifying those who are at risk of developing MI, ACS, stroke or PAOD, in particular are described. The invention also provides methods of prophylaxis therapy for MI in human subjects having a race including black African ancestry by administering to the subject a composition comprising a therapeutically effective amount of MI therapeutic agent that inhibits leukotriene synthesis in vivo. The invention also provides for compositions comprising a leukotriene synthesis inhibitor and a statin and methods of using these compositions to reduce C-reactive protein in a human subject at risk of MI, ACS, stroke and/or PAOD.

1 Claim, 11 Drawing Sheets

| | Haplotypes | | | | | | | | | Frequency |
|---|---|---|---|---|---|---|---|---|---|---|
| HapL | C | G | T | A | T | T | T | A | G | 0.480 |
| HapK | C | G | T | A | T | T | C | G | G | 0.104 |
| | T | G | T | G | C | C | G | T | A | A | 0.079 |
| | C | G | C | G | T | T | G | T | A | G | 0.060 |
| | T | G | T | G | C | C | G | C | G | G | 0.059 |
| | T | A | T | G | T | C | G | T | A | A | 0.053 |
| | C | G | T | G | T | C | T | T | G | G | 0.044 |
| | T | G | T | G | C | C | G | T | A | G | 0.031 |
| | C | G | T | A | T | T | T | A | A | 0.019 |
| HapQ | C | G | T | G | T | C | T | T | A | G | 0.013 |
| | C | A | T | G | T | C | G | T | A | A | 0.011 |
| | C | G | C | G | T | T | G | T | A | A | 0.011 |

U.S. PATENT DOCUMENTS

| | | | |
|---|---|---|---|
| 4,873,191 A | 10/1989 | Wagner et al. |
| 4,970,215 A | 11/1990 | Mohrs et al. |
| 4,996,230 A | 2/1991 | Gapinski |
| 5,006,530 A | 4/1991 | Angerbauer et al. |
| 5,011,930 A | 4/1991 | Fujikawa et al. |
| 5,030,447 A | 7/1991 | Joshi et al. |
| 5,059,609 A | 10/1991 | Eggler et al. |
| 5,126,971 A | 6/1992 | Lin et al. |
| 5,143,854 A | 9/1992 | Pirrung et al. |
| 5,177,080 A | 1/1993 | Angerbauer et al. |
| 5,180,589 A | 1/1993 | Joshi et al. |
| 5,260,440 A | 11/1993 | Hirai et al. |
| 5,273,995 A | 12/1993 | Roth |
| 5,283,252 A | 2/1994 | Raddatz et al. |
| 5,288,644 A | 2/1994 | Beavis et al. |
| 5,288,743 A | 2/1994 | Brooks et al. |
| 5,288,751 A | 2/1994 | Brooks et al. |
| 5,298,512 A | 3/1994 | Eggler et al. |
| 5,306,820 A | 4/1994 | Decker et al. |
| 5,354,772 A | 10/1994 | Kathawala |
| 5,356,896 A | 10/1994 | Kabadi et al. |
| 5,385,929 A | 1/1995 | Bjorge et al. |
| 5,403,860 A | 4/1995 | Kurabayashi et al. |
| 5,506,219 A | 4/1996 | Robl |
| 5,527,827 A | 6/1996 | Delorme et al. |
| 5,549,150 A | 8/1996 | Williams |
| 5,549,879 A | 8/1996 | Chow |
| 5,559,134 A | 9/1996 | Buchmann et al. |
| 5,576,338 A | 11/1996 | Friesen et al. |
| 5,616,596 A | 4/1997 | Basha et al. |
| 5,622,985 A | 4/1997 | Olukotun et al. |
| 5,641,789 A | 6/1997 | Marfat |
| 5,686,104 A | 11/1997 | Mills et al. |
| 5,691,322 A | 11/1997 | Robl |
| 5,753,675 A | 5/1998 | Wattanasin |
| 5,763,646 A | 6/1998 | Kumar et al. |
| 5,763,653 A | 6/1998 | Khanna et al. |
| 5,939,529 A | 8/1999 | Potempa |
| 5,969,156 A | 10/1999 | Briggs et al. |
| 5,981,559 A | 11/1999 | Nagaoka et al. |
| 5,990,148 A | 11/1999 | Isakson et al. |
| 6,040,147 A | 3/2000 | Ridker et al. |
| 6,126,971 A | 10/2000 | Mills et al. |
| 6,166,031 A | 12/2000 | Eggler et al. |
| RE37,314 E | 8/2001 | Hirai et al. |
| 6,316,460 B1 | 11/2001 | Creekmore et al. |
| 6,436,924 B2 | 8/2002 | Poppe et al. |
| 6,506,876 B1 | 1/2003 | Chandrakumar et al. |
| 6,521,747 B2 | 2/2003 | Anastasio et al. |
| 6,531,279 B1 | 3/2003 | Blumenfeld et al. |
| 6,544,730 B1 | 4/2003 | Deininger |
| 6,576,669 B2 | 6/2003 | Anderskewitz et al. |
| 6,589,959 B1 | 7/2003 | Taylor et al. |
| 6,797,475 B2 | 9/2004 | Barnes et al. |
| 6,803,379 B2 | 10/2004 | Fernandez-Pol et al. |
| 6,825,015 B1 | 11/2004 | Pflaum et al. |
| 6,838,566 B2 | 1/2005 | Pflaum et al. |
| 7,034,000 B2 | 4/2006 | Rogers |
| 2002/0107276 A1 | 8/2002 | Isakson et al. |
| 2003/0004101 A1 | 1/2003 | Rogers |
| 2003/0194721 A1 | 10/2003 | Mikita et al. |
| 2003/0225155 A1 | 12/2003 | Fernandez-Pol et al. |
| 2004/0014759 A1 | 1/2004 | Picard et al. |
| 2004/0053983 A1 | 3/2004 | Barvian et al. |
| 2004/0209288 A1 | 10/2004 | Mehrabian |
| 2005/0282855 A1 | 3/2005 | Helgadottir et al. |

FOREIGN PATENT DOCUMENTS

| | | |
|---|---|---|
| DE | 4118014 | 12/1992 |
| DE | 4118173 | 12/1992 |
| DE | 4127842 | 2/1993 |
| DE | 100 07203 | 8/2001 |
| EP | 0142146 | 5/1985 |
| EP | 0065835 | 11/1985 |
| EP | 0221025 | 5/1987 |
| EP | 276064 | 7/1988 |
| EP | 0 360 246 | 3/1990 |
| EP | 405116 | 1/1991 |
| EP | 0 419 049 | 3/1991 |
| EP | 422329 | 4/1991 |
| EP | 0 466 452 | 1/1992 |
| EP | 0 518 819 | 12/1992 |
| EP | 0 518 819 A2 | 12/1992 |
| EP | 0 344 519 | 4/1993 |
| EP | 0 549 879 | 7/1993 |
| EP | 0 623 614 | 11/1994 |
| EP | 0 509 359 | 2/1996 |
| EP | 0 703 216 | 3/1996 |
| EP | 743064 | 11/1996 |
| EP | 0 870 762 | 10/1998 |
| EP | 0 947 502 | 10/1999 |
| FR | 2596393 | 10/1987 |
| GB | 2055100 | 2/1981 |
| GB | 2073199 | 10/1981 |
| GB | 2205837 | 12/1988 |
| JP | 03227922 | 10/1991 |
| JP | 06072947 | 3/1994 |
| JP | 3-227922 | 12/1998 |
| JP | 00355551 | 12/2000 |
| JP | 2003238407 | 8/2003 |
| WO | WO-86/03488 | 6/1986 |
| WO | WO-86/07054 | 12/1986 |
| WO | WO-91/13908 | 9/1991 |
| WO | WO-92/03132 | 3/1992 |
| WO | WO-94/00420 | 1/1994 |
| WO | WO-95/00487 | 1/1995 |
| WO | WO-95/07249 | 3/1995 |
| WO | WO-95/11995 | 5/1995 |
| WO | WO-95/18610 | 7/1995 |
| WO | WO-96/11192 | 4/1996 |
| WO | WO-96/27585 | 9/1996 |
| WO | WO-96/41625 | 12/1996 |
| WO | WO-97/29774 | 8/1997 |
| WO | WO-97/29775 | 8/1997 |
| WO | WO-97/34885 | 9/1997 |
| WO | WO-98/09943 | 3/1998 |
| WO | WO-98/11085 | 3/1998 |
| WO | WO-98/13347 | 4/1998 |
| WO | WO-98/40354 | 9/1998 |
| WO | WO-98/40364 | 9/1998 |
| WO | WO-98/40370 | 9/1998 |
| WO | WO-98/42345 | 10/1998 |
| WO | WO-98/43954 | 10/1998 |
| WO | WO 99/52942 | 10/1999 |
| WO | WO-99/59964 | 11/1999 |
| WO | WO-00/43001 | 7/2000 |
| WO | WO-00/50577 | 8/2000 |
| WO | WO-00/59864 | 10/2000 |
| WO | WO-01/17528 | 3/2001 |
| WO | WO-01/34199 | 5/2001 |
| WO | WO-01/57025 | 8/2001 |
| WO | WO-01/96347 | 12/2001 |
| WO | WO-02/05825 | 1/2002 |
| WO | WO-02/060378 | 8/2002 |
| WO | WO-03/035670 | 5/2003 |
| WO | WO-03/037349 | 5/2003 |
| WO | WO-03/063781 | 8/2003 |
| WO | WO-03/082191 | 10/2003 |
| WO | WO-03/086282 | 10/2003 |
| WO | WO-03/103602 | 12/2003 |
| WO | WO-2004/002409 | 1/2004 |
| WO | WO-2004/012686 | 2/2004 |
| WO | WO-2004/024186 | 3/2004 |
| WO | WO-2004/035741 | 4/2004 |
| WO | WO-2004/035746 | 4/2004 |
| WO | WO-2004/047648 | 6/2004 |
| WO | WO-2004/052839 | 6/2004 |
| WO | WO-2004/055520 | 7/2004 |
| WO | WO-2005/027866 | 3/2005 |

OTHER PUBLICATIONS

Asztalos et al., Comparing the effects of five different statins on the HDL subpopulation profiles of coronary heart disease patients, Atherosclerosis, 164(2):361-369, 2002.

Berry et al., Comparison of the dose-response relationships of 2 lipid-lowering agents: a Bayesian meta-analysis, Am. Heart. J., 145(6):1036-1045, 2003.

GenBank accession No. J03459, Human leukotriene A-4 hydrolase mRNA, complete cds, Jun. 11, 1993.

GenBank accession No. Z24370, *H. sapiens* (D13S289) DNA segment containing (CA) repeat; clone AFM321xb1; single read, Nov. 28, 1994.

GenBank accession No. Z52271, *H.sapiens* (D13S1238) DNA segment containing (CA) repeat; clone AFMa142zb5; single read, sequence tagged site, Sep. 9, 2004.

Gudmundsson et al., Localization of a gene for peripheral arterial occlusive disease to chromosome 1p31, Am. J. Hum. Genet., 70:586-592, 2002.

Hakansson et al., Effect of in vivo administration of G-CSF on neutrophil and eosinophil cell surface expression of $FC_7$- and complement receptors [abstract WO05/06], International Congress of the Inflammation Research Association ($7^{th}$), S237, White Haven, 1994.

Hatzelmann et al., Mode of action of the leukotriene synthesis (FLAP) inhibitor BAY X1005: implications for biological regulation of 5-lipoxygenase, Advances in Prostaglandin, Thromboxane, and Leukotriene Res., 22:23-31, 1994.

Helgadottir et al., The gene encoding 5-lipoxygenase activating protein confers risk of myocardial infarction and stroke, Nat. Genet., 36(3):233-239, 2004.

International Preliminary Examination Report, PCT/US2003/32556, European Patent Office, Nov. 21, 2005.

International Preliminary Report on Patentability, PCT/US2005/03312, European Patent Ofice, Jul. 31, 2006.

International Search Report, PCT/US2003/32556, European Patent Office, Oct. 21, 2004.

International Search Report, PCT/US2005/03312, European Patent Office, May 26, 2006.

International Search Report, PCT/US2006/12073, European Patent Office, Oct. 5, 2006.

International Symposium on Medicinal Chemistry ($13^{th}$), Paris, p. 197, 1994.

Jorgenson et al., Ethnicity and human genetic linkage maps, Am. J. Hum. Genet., 76(2):276-290, 2005.

National Heart, Lung, and Blood Institute et al., Update on cholesterol guidelines: more-intensive treatment options for higher risk patients, www.nih.gov/news/pr/jul2004/nhIbi-12.htm, 2004.

Ong et al., Protecting the heart: a practical review of the statin studies, Medscape General Medicine, 4(4), Dec. 10, 2002.

Quinoline 5-lipoxygenase inhibitors, Cur. Opinion Ther. Patents, 2(12):2007-2008, 1992.

Ridker et al., Inflammation, aspirin, and the risk of cardiovascular disease in apparently healthy men, N. Engl. J. Med., 336:973-979, 1997.

Ridker, C-reactive protein: a simple test to help predict risk of heart attack and stroke, Circulation, 108:e81-e85, 2003.

Stancu et al., Statins: mechanism of action and effects, J. Cell. Mol. Med, 5(4):378-387, 2001.

Written Opinion of the International Searching Authority, PCT/US2005/03312, European Patent Office, May 26, 2006.

Written Opinion of the International Searching Authority, PCT/US2006/12073, European Patent Office, Oct. 5, 2006.

Batkai et al., "Inhibition of 4-lipoxygenase Improves Regional Myocardial Function After Repetitive Ischemia in the Rat Heart," Pluegers Archiv., Springer Verlag, 430(4):R18 (1995).

Dib et al., "A Comprehensive Genetic Map of the Human Genome Based on 5,264 Microsatellites," Nature, 380:152-154 (1996).

European Search Report for EP 03 78 3063 dated Jul. 18, 2006.

Hatzelmann et al., Inversely-correlated Inhibition of Human 5-lipoxygenase Activity by BAY X1005 and Other Quinoline Derivatives in Intact Cells and a Cell-Free System: Implications for the Function of 5-lipoxygenase Activating Protein, Biochemical Pharmacology, 47:2259-2268 (1994).

Koshino et al., "Novel Polymorphism of the 5-lipoxygenase Activating Protein (FLAP) Promoter Gene Associated with Asthma," Molecular Cell Biology Research Communiciations, 2:32-35 (1999).

Yandava et al., "Cytogenetic and Radiation Hybrid Mapping of Human Arachidonate 5-lipoxygenase-activating Protein (ALOX5AP) to Chromosome 13q12," Genmoics, 56:131-133 (1999).

Morgan et al., Nonvalidation of Reported Genetic Risk Factors for Acute Coronary Syndrome in a Large-Scale Replication Study, *J. Amer. Med. Assoc.*, 297: 1551-1561 (Apr. 11, 2007).

Ahmed et al., "Serial Intravascular Ultrasound Assessment of the Efficacy of Intracoronary γ-Radiation Therapy for Preventing Recurrence in Very Long, Diffuse, In-Stent Restenosis Lesions," *Circ.*, 104:856-859 (2001).

Aiello et al., "Leukotriene B4 Receptor Antagonism Reduces Monocytic Foam Cells in Mice," *Arterioscler. Thromb. Vasc. Biol.*, 22:443-449 (2002).

Allen et al., "Differential Leukotriene Constrictor Responses in Human Atherosclerotic Coronary Arteries," *Circulation*, 97:2406-2413 (1998).

Allen et al., "Enhanced Excretion of Urinary Leukotriene E4 in Coronary Artery Disease and After Coronary Artery Bypass Surgery," *Coronary Artery Disease*, 4:899-904 (1993).

Andresdottir et al., "Fifteen Percent of Myocardial Infarctions and Coronary Revascularizations Explained by Family History Unrelated to Conventional Risk Factors," *European Heart Journal*, 23:1655-1663 (2002).

Askonas et al., "Pharmacological Characterization of SC-57461A (3-[Methyl[3-[4-(Phenylmethyl)Phenoxy]Propyl]Amino]Propanoic Acid HCI), a Potent and Selective Inhibitor of Leukotriene A4 Hydrolase I: In Vitro Studies," *JPET*, 300:577-582 (2002).

Bakr et al., "5-Lipoxygenase and Leukotriene A4 Hydrolase Expression in Primary Nephrotic Syndrome," *Pediatr Nephrol*, 19:396-399 (2004).

Bamshad et al., "Deconstructing the Relationship Between Genetics and Race," *Nat. Rev. Genet.*, 5:598-609 (2004).

Barnholtz-Sloan et al., *Cancer Epidemiol Biomarkers Prev.*, 14:1545-1551 (2005).

Barone et al., "Time-Related Changes in Myeloperoxidase Activity and Leukotriene B4 Receptor Binding Reflect Leukocyte Influx in Cerebral Focal Stroke," *Mol. Chem. Neuropathol.*, 24:13-30 (1995).

Barth, "Which Tools are in your Cardiac Workshop? Carotid Ultrasound, Endothelial Function, and Magnetic Resonance Imaging," *Am. J. Cardiol.*, 87(suppl) 8A-14A (2001).

Bermudez et al, "Interrelationships Among Circulating Interleukin-6, C-Reactive Protein, and Traditional Cardiovascular Risk Factors in Women," *Arterioscler Thromb Vasc Biol.*, 22:1668-1673 (2002).

Birke et al., "In Vitro and in Vivo Pharmacological Characterization of BIIL 284, a Novel and Potent Leukotriene B4 Receptor Antagonist," *JPET*, 297:458-466 (2001).

Blackie et al., "The Identification of Clinical Candidate SB-480848: A Potent Inhibitor of Lipoprotein-Associated Phospholipase A2," *Bioorganic Med. Chem. Lett.*, 13:1067-1070 (2003).

Blake et al, "C-Reactive Protein, Subclinical Atherosclerosis, and Risk of Cardiovascular Events," *Arterioscler. Thromb. Vasc. Biol.*, 22:1512-1513 (2002).

Blake et al., "Projected Life-Expectancy Gains With Statin Therapy for Individuals With Elevated C-Reactive Protein Levels," *JACC*, 40:49-55 (2002).

Boyd et al., "N-1 Substituted Pyrimidin-4-Ones: Novel, Orally Active Inhibitors of Lipoprotein-Associated Phospholipase A2," *Bioorganic Med. Chem. Lett.*, 10:2557-2561 (2000).

Brennan et al., "Prognostic Value of Myeloperoxidase in Patients with Chest Pain," *N. Eng J. Med.*, 349:1595-1604 (2003).

Buffon et al., "Widespread Coronary Inflammation in Unstable Angina," *N. Engl. J. Med.*, 1:5-12 (2002).

Byrum et al., "Determination of the Contribution of Cysteinyl Leukotrienes and Leukotriene B4 in Acute Inflammatory Responses Using 5-Lipoxygenase- and Leukotriene A4 Hydrolase-Deficient Mice," *J. Immunol.*, 163:6810-6819 (1999).

Carry et al., "Increased Urinary Leukotriene Excretion in Patients with Cardiac Ischemia; In vivo Evidence for 5-Lipoxygenase Activation," *Circulation*, 85: 232-236 (1992).

Caslake et al., "Lipoprotein-Associated Phospholipase A2 (Platelet-Activating Factor Acetylhydrolase) and Cardiovascular Disease," *Curr. Opin. Lipidol.*, 14:347-352 (2003).

Chang et al., "C-Reactive Protein Binds to Both Oxidized LDL and Apoptotic Cells Through Recognition of a Common Ligand: Phosphorylcholine of Oxidized Phospholipids," *PNAS*, 99:13043-13048 (2002).

Chen et al., "Leukotriene A4 Hydrolase in Rat and Human Esophageal Adenocarcinomas and Inhibitory Effects of Bestatin," *J. of the Natl. Cancer Institute*, 95:1053-1060 (2003).

Collins et al., "Effects of Cholesterol-Lowering with Simvastatin on Stroke and Other Major Vascular Events in 20 536 People with Cerebrovascular Disease or Other High-Risk Conditions," *Lancet*, 363:757-767 (2004).

Cyrus et al., "Effect of Low-Dose Aspirin on Vascular Inflammation, Plaque Stability, and Artherogenesis in Low-Density Lipoprotein Receptor-Deficient Mice," *Circ.*, 106:1282-1287 (2002).

Dahlen et al., "Inhibition of Allergen-Induced Airway Obstruction and Leukotriene Generation in Atopic Asthmatic Subjects by the Leukotriene Biosynthesis Inhibitor BAYx 10005," *Thorax*, 52:342-347 (1997).

Danesh et al., "C-Reactive Protein and Other Circulating Markers of Inflammation in the Prediction of Coronary Heart Disease," *N. Engl. J. Med.*, 350:1387-1397 (2004).

Davidson, "Introduction: Utilization of Surrogate Markers of Atherosclerosis for the Clinical Development of Pharmaceutical Agents," *Am. J. Cardiol.*, 87(suppl):1A-7A (2001).

De Caterina et al., "Leukotriene B4 Production in Human Atherosclerotic Plaques," *Biomed. Biochim. Acta*, 47:S182-85 (1988).

Dempster et al., "Maximum Likelihood from Incomplete Data via the $EM$ Algorithm," *J. R. Stat. Soc. B*, 39:1-38 (1977).

Devillier et al., "Leukotrienes, Leukotriene Receptor Antagonists and Leukotriene Synthesis Inhibitors in Asthma: An Update. Part II: Clinical Studies with Leukotriene Receptor Antagonists and Leukotriene Synthesis Inhibitors in Asthma," *Pharmacol. Res.*, 40:15-29 (1999).

Djuric et al., "Synthesis and Pharmacological Activity of SC-53228, A Leukotriene B4 Receptor Antagonist with High Intrinsic Potency and Selectivity," *Bioorganic and Medicinal*.

Doggen et al., "C-Reactive Protein, Cardiovascular Risk Factors and the Association With Myocardial Infarction in Men," *J. Intern. Med.*, 248:406-414 (2000).

Drazen et al., "Pharmacogenetic Association Between ALOX5 Promoter Genotype and the Response to Anti-Asthma Treatment," *Nat. Genet.*, 22:168-170 (1999).

Drugs of the Future, 20(10):1057, DS-4574 (1995).

Duthie et al., "Homocysteine, B Vitamin Status, and Cognitive Function in the Elderly," *Am J Clin. Nutr.*, 75:908-913 (2002).

Dwyer et al., "Arachidonate 5-Lipoxygenase Promoter Genotype, Dietary Arachidonic Acid, and Atherosclerosis," *N. Eng. J. Med.*, 350:29-37 (2004).

Eberhard et al., "Leukotriene A4-Hydrolase Expression and Leukotriene B4 Levels in Chronic Inflammation of Bacterial Orgin; Immunohistochemistry and Reverse-Phase High-Performance Liquid Chromatography Analysis of Oral Mucosal Epithelium," *Virchows Arch*, 440:627-634 (2002).

Falk et al., "Haplotype Relative Risks: An Easy Reliable Way to Construct a Proper Control Sample for Risk Calculations," *Ann. Hum. Genet.*, 51:227-233 (1987).

Falush et al., "Inference of Population Structure Using Multilocus Genotype Data: Linked Loci and Correlated Allele Frequencies," *Genetics*, 164:1567-1587 (2003).

Fauler et al., "Cardiovascular Effects of Leukotrienes," *Cardiovasc. Drugs Ther.*, 3:499-505 (1989).

Feltenmark et al., "Diverse Expression of Cytosolic Phospholipase A2, 5-Lipoxygenase and Prostaglandin H Synthase 2 in Acute Pre-B-Lymphocytic Leukaemia Cells," *British J. of Haematology*, 90:585-594 (1995).

Fischer et al., "Effect of a Novel 5-Lipoxygenase Activating Protein Inhibitor, BAYx 1005, on Asthma Induced by Cold Dry Air," *Thorax*, 52:1074-1077 (1997).

Folcik et al., "Lipoxygenase Contributes to the Oxidation of Lipids in Human Atherosclerotic Plaques," *J. Clin. Invest.*, 96:504-510 (1995).

Folco et al., "Leukotrienes in Cardiovascular Diseases," *Am. J. Respir. Crit. Care Med.*, 161:S112-S116 (2000).

Frenette et al., "Substituted Indoles as Potent and Orally Active 5-Lipoxygenase Activating Protein (Flap) Inhibitors," *Bioorg. Med. Chem. Lett.*, 9:2391-2396 (1999).

Friedrich et al., "Mechanisms of Leukotriene B4—Triggered Monocyte Adhesion," *Arterioscler. Thromb. Vasc. Biol.*, 23:1761 (2003).

Funk et al., "Molecular Cloning and Amino Acid Sequence of Leukotriene A4 Hydrolase," *Proc. Natl. Acad. Sci.*, 84:6677-6681 (1987).

Funk, C., "Prostaglandins and Leukotrienes: Advances in Eicosanoid Biology," *Science*, 294:1871-1875 (2001).

Gompertz et al., "A Randomized, Placebo-Controlled Trial of a Leukotriene Synthesis Inhibitor in Patients with COPD," *Chest.*, 122:289-94 (2002).

Gretarsdottir et al. "Localization of a Susceptibility Gene for Common Forms of Stroke to 5q12," *Am. J. Hum. Genet.*, 70:593-603 (2002).

Gretarsdottir et al., "The Gene Encoding Phosphodiesterase 4D Confers Risk of Ischemic Stroke," *Nat Genet*, 35:131-138 (2003).

Gudbjartsson et al., "Allegro, a New Computer Program for Multipoint Linkage Analysis," *Nat Genet.*, 25:12-13 (2000).

Gulcher et al., "Protection of Privacy by Third-Party Encryption in Genetic Research in Iceland," *Eur. J. Hum. Genet.*, 8:739-742 (2000).

Hagenaars et al., "Rationale and Design for the SARIS Trial; Effect of Statin on Atherosclerosis and Vascular Remodeling Assessed with Intravascular Sonography," *Cardiovasc. Drugs Ther.*, 15:339-343 (2001).

Hakonarson et al, "Bi-Directional Activation Between Human Airway Smooth Muscle Cells and T Lymphocytes: Role in Induction of Altered Airway Responsiveness1," *J. Immunol.*, 166:293-303 (2001).

Hamilton et al., "Attenuation of Early and Late Phase Allergen-Induced Bronchoconstriction in Asthmatic Subjects by a 5-Lipoxygenase Activating Protein Antagonist, BAYx 1005," *Thorax*, 52:348-354 (1997).

Heinzmann et al., "Studies on Linkage and Association of Atopy with the Chromosomal Region 12q13-24," *Clin. Exp. Allergy*, 30:1554-1561 (2000).

Helgadottir et al., "Familial Clustering of Myocardial Infarction in the Icelandic Population: Evidence for Genetic Compoents," *Am. J. of Human Gen.*, 84:A205: 1128 (1999).

Helgadottir et al., "The Gene Encoding 5-Lipoxygenase Activating Protein Confers Risk of Myocardial Infarction and Stroke," *Nat. Genet.*, 36:233-239 (2004).

Hoggart et al., "Control of Confounding of Genetic Associations in Stratified Population," *Am. J. Hum. Genet.*, 72:1492-1504 (2003).

In et al., "Naturally Occurring Mutations in the Human 5-Lipoxygenase Gene Promoter that Modify Transcription Factor Binding and Reporter Gene Transcription," *J. Clin. Invest.*, 99:1130-1137 (1997).

"Increased Spending at Vanguard . . . VML 295 Studies Discontinued," SCRIP World Pharmaceutical New, 2272 (13) [for VML-295] (1997).

International Preliminary Report on Patentability for International Application No. PCT/US2004/030582 dated Dec. 8, 2005.

International Search Report for International Application No. PCT/US2004/030582 dated May 23, 2005.

International Search Report for PCT/US2003/32805 dated Jan. 14, 2005.

International Search Report for PCT/US2004/030582 dated Feb. 28, 2005.

Ishizaka et al., "Increased Leukotriene A4 Hydrolase Expression in the Heart of Angiotensin II-Induced Hypertensive Rat," *FEBS Letters*, 463:155-159 (1999).

Jackson et al., "Design, Synthesis, and Pharmacological Evaluation of Potent Xanthone Dicarboxylic Acid Leukotriene B4 Receptor Antagonists," *J. Med. Chem.*, 36:1726-1734 (1993).

Jonsdottir et al., "Incidence and Prevalence of Recognised and Unrecognised Myocardial Infarction in Women," *Eur. Heart J.*, 19:1011-1018 (1998).

Jorde et al., "Genetic Variation, Classification and 'Race'," *Nat. Genet.*, 36:S28-33 (2004).

Kachur et al., "Pharmacological Characterization of SC-57461A (3-[Methyl[3-[4-(Phenylmethyl)Phenoxy]Propyl]Amino]Propanoic Acid HCI), a Potent and Selective Inhibitor of Leukotriene A4 Hydrolase II: In Vivo Studies," *JPET*, 300:583-587 (2002).

Kaiser et al., "Proteomics Applied to the Clinical Follow-up of Patients After Allogeneic Hematopoietic Stem Cell Transplantation," *Blood*, 104:340-349 (2004).

Kanayama et al., "A New Prostacyclin Analog, KP-10614, Inhibits Platelet-Polymorphonuclear Leukocyte Interaction and Limits Experimental Infarct Size in Rat Heart," *J. Pharmacol. Exp. Ther.*, 266:344-349 (1993).

Keaney, Jr. et al., "The Value of Inflammation for Predicting Unstable Angina," *N. Engl. J. Med.*, 347:55-57 (2002).

Kolasa et al., "Synthesis of Indolylalkoxyiminoalkylcarboxylates as Leukotriene Biosynthesis Inhibitors," *Bioorg. Med. Chem.*, 5:507-514 (1997).

Kong et al., "A High-Resolution Recombination Map of the Human Genome," *Nat. genet.*, 31:241-247 (2002).

Kong et al., "Allele-Sharing Models: LOD Scores and Accurate Linkage Tests," *Am. J. Hum. Genet.*, 61:1179-1188 (1997).

Kreft et al., "Conversion of a Cyclooxygenase (CO) Inhibitor into a 5-Lipoxygenase (LO) Inhibitor: A General Route to Novel Orally Active Anti-Inflammatory and Anti-Allergy Drugs," *Drugs Exptl. Clin. Res.*, 17:381-387 (1991).

Kristjansson et al., "Improved One-Year Survival After Acute Myocardial Infarction in Iceland Between 1986 and 1996," *Cardiology*, 91:210-214 (1999).

Kruglyak et al., "Parametic and Nonparametric Linkage Analysis: A Unified Multipoint Approach," *Am. J. Hum. Genet.*, 58:1347-1363 (1996).

Kuhn et al., "Amino Acids Differences in the Deduced 5-Lipoxygenase Sequence of CAST Atherosclerosis-Resistance Mice Confer Impaired Activity when Introduced Into the Human Ortholog," *Arterioscler. Thromb. Vasc. Biol.*, 23:1072-1076 (2003).

Kuribayashi et al., "Inhibitory Effects of a Phosphate Diester of a-Tocopherol and Ascorbic Acid (EPC-K1) on Myocardial Infarction in Rats," *Int. J. Tiss. Reac.*, 18:73-79 (1996).

Lam et al., "Leukotriene C4 Uses a Probenecid-Sensitive Export Carrier That Does Not Recognize Leukotriene B4," *PNAS USA*, 89:11598-11602 (1992).

Lehr et al., "Involvement of 5-Lipoxygenase Products in Cigarette Smoke-Induced Leukocyte/Endothelium Interaction in Hamsters," *Int. J. Microcirc.: Clin. Exp.*, 12:61-73 (1993).

Long et al., "The Genetic Structure of Admixed Populations," *Genetics*, 127:417-428 (1991).

MacLeod et al., "No Association Between Glu/Asp Polymorphism of NOS3 Gene and Ischemic Stroke," *Neurology*, 53:418-420 (1999).

Magee et al., "An Integrated Pharmacokinetic/Pharmacodynamic (PK/PD) Model for SB-480848 Inhibition of Plasma Lipoprotein-Associated Phospholipase A2 (LP-PLA2) Enzyme Activity in Human," *American Society for Clinical Pharm. and Ther. Abstract* PIII-87 (2003).

Mehrabian et al., "Identification of 5-Lipoxygenase as a Major Gene Contributing to Atherosclerosis Susceptibility in Mice," *Circ. Res.*, 91:120-126 (2002).

Meiklejohn et al., "Plasma Homocysteine Concentrations in the Acute and Convalescent Periods of Atherothrombotic Stroke," *Stroke*, 32:57-62 (2001).

Menegatti et al., "Gene Expression of 5-Lipoxygenase and LTA4 Hydrolase in Renal Tissue of Nephrotic Syndrome Patients," *Clin. Exp. Immunol*, 116:347-353 (1999).

Montero et al., "LTA4 Hydrolase Expression During Glomerular Inflammation: Correlation of Immunohistochemical Localization with Cytokine Regulation," *Adv. Exp. Med. Biol.*, 449-454 (1999).

Mueller et al., "Leukotriene A4 Hydrolase, Mutation of Tyrosine 378 Allows Conversiion of Leukotriene A4 into an Isomer of Leukotriene B4," *J. Biol. Chem.*, 271:24345-24348 (1996).

Muller-Peddinghaus et al., "BAY X1005, A New Inhibitor of Leukotriene Synthesis: in Vivo Inflammation Pharmacology and Pharmacokinetics," *J. Pharmacol. Exp. Ther.*, 267:51-57 (1993).

Muller-Peddinghaus et al., "BAY X1005, A New Selective Inhibitor of Leukotriene Synthesis: Pharmacology and Pharmacokinetics," *J. Lipid. Mediat.*, 6:245-248 (1993).

Muller-Peddinghaus, R., "Potential Anti-Inflammatory Effects of 5-Lipoxygenase Inhibition—Exemplified by the Leukotriene Synthesis Inhibitor Bay X 1005," *J. Phys. Pharmacol.*, 48:529-536 (1997).

Nissen et al., "Statin Therapy, LDL Cholesterol, C-Reactive Protein, and Coronary Artery Disease," *N. Engl. J. Med.*, 352:29-38 (2005).

Nissen, S., "Coronary Angiography and Intravascular Ultrasound," *Am. J. Cardiol.*, 87(suppl):15A-20A (2001).

Oestvang et al., "Role of Secretory and Cystolic Phospholipase A2 Enzymes in Lysophosphatidylcholine-Stimulated Monocyte Arachidonic Acid Release," *FEBS Lett.*, 555:257-262 (2003).

Okano-Mitani et al., "Leukotriene A4 Hydrolase in Peripheral Leukocytes of Patients with Atopic Dermatitis," *Arch Dermatol Res.*, 288:168-172 (1996).

Ozaki et al., "Functional SNPs in the Lymphotoxin-a Gene that are Associated with Susceptibility to Myocardial Infarction," *Nat. Genet.*, Published online: Nov. 11, 2002, doi:10.1038/ng1047, pp. 1-5 (2002).

Packard, et al., "Lipoprotein-Associated Phospholipase A2 as an Independent Predictor of Coronary Heart Disease," *N. Eng. J. Med.*, 343:1148-1155 (2000).

Parra et al., "Estimating African American Admixture Proportions by Use of Populartion-Specific Alleles," *Am. J. Hum. Genet.*, 63:1839-1851 (1998).

Paterniti, "Investigational New Drug Applications: The Role of the Preclinical Dossier," *Am. J. Cardiol.*, 81(suppl):10F-12F (1998).

Pearson et al., "Markers of Inflammation and Cardiovascular Disease," *Circulation*, 107:499-511 (2003).

Penning et al., "Inhibitors of Leukotriene A4 (LTA4) Hydrolase as Potential Anti-Inflammatory Agents," *Current Pharmaceutical Design*, 7:163-179 (2001).

Penning et al., "Pyrrolidine and Piperidine Analogues of SC-57461A as Potent, Orally Active Inhibitors of Leukotriene A4 Hydrolase," *Bioorg. Med. Chem. Lett.*, 12:3383-3386 (2002).

Penning et al., "Second-Generation Leukotriene B4 Receptor Antagonists Related to SC-41930: Heterocyclic Replacement of the Methyl Ketone Pharmacophore," *J. Med. Chem.*, 38:858-868 (1995).

Penning et al., "Structure-Activity Relationship Studies on 1-[2(4-Phenylphenoxy)Ethyl]Pyrrolidine (SC-22716), a Potent Inhibitor of Leukotriene A4 (LTA4) Hydrolase," *J. Med. Chem.*, 43:721-735 (2000).

Penning et al., "Synthesis of Imidazopyridines and Purines as Potent Inhibitors of Leukotriene A4 Hydrolase," *Bioorg. Med. Chem. Lett.*, 13:1137-1139 (2003).

Penning et al., "Synthesis of Potent Leukotriene A4 Hydrolase Inhibitors. Identification of 3-[Methyl[3-[4-(Phenylmethyl)Phenoxy]Propyl]Amino]Propanoic Acid," *J. Med. Chem.*, 45:3482-3490 (2002).

Pitt et al., "Aggressive Lipid-Lowering Therapy Compared with Angioplasty in Stable Coronary Artery Disease," *N. Eng. J. Med.*, 341:70-76 (1999).

Potempa et al., "Stimulatory Effects of the C-Reactive Protein Subunit on Monocyte Function, Including Release of IL-1," *Biol. Fluids* 34: 287-290.

Pritchard et al., "Association Mapping in Structured Populations," *Am. J. Hum. Genet.*, 67:170-181 (2000).

Pritchard et al., "Inference of Population Structure Using Multilocus Genotype Data," *Genetics*, 155:945-959 (2000).

Radmark, "5-Lipoxygenase-Derived Leukotrienes. Mediators Also of Atherosclerotic Inflammation," *Arterioscler. Thromb. Vasc. Biol.*, 23:1140-1142 (2003).

Raggi, "Coronary Calcium on Electron Beam Tomography Imaging as a Surrogate Marker of Coronary Artery Disease," *Am. J. Cardiol.*, 87(suppl):27A-34A (2001).

Reiner et al., "Population Striucture, Admixture, and Aging-Related Phenotypes in African American Adults: The Cardiovascular Health Study," Am. *J. Hum. Genet.*, 76:463-477 (2005).

Retterstol et al., "C-Reactive Protein Predicts Death in Patients With Previous Premature Myocardial Infarction—A 10 Year Follow-Up Study," *Atherosclerosis*, 160:433-440 (2002).

"Rhone-Poulenc Rorer's Product Pipeline," *SCRIP World Pharmaceutical News*, 2168 :20-21 (1996).

Ridker et al, "Comparison of C-Reactive Protein and Low-Density Lipoprotein Cholesterol Levels in the Prediction of First Cardiovascular Events," *N.Engl. J. Med.*, 347:1557-1565 (2002).
Ridker et al., "C-Reactive Protein and Other Markers of Inflammation in the Prediction of Cardiovascular Disease in Women," *N. Engl. J. Med.*, 342:836-843 (2000).
Ridker et al., "C-Reactive Protein Levels and Outcomes after Statin Therapy," *N.Engl. J. Med.*, 352:20-28 (2005).
Ridker et al., "Inflammation, Pravastatin, and the Risk of Coronary Events After Myocardial Infarction in Patients with Average Cholesterol Levels," *Circulation*, 98:839-844 (1998).
Rosenfeld, "Leukocyte Recruitment Into Developing Atherosclerotic Lesions. The Complex Interaction Between Multiple Molecules Keeps Getting More Complex," *Arterioscler. Thromb. Vasc. Biol.*, 22:361-363 (2002).
Ross, R., "Atherosclerosis—An Inflammatory Disease," *N. Eng. J. Med.*, 340:115-126 (1999).
Rossoni et al., "Myocardial Protection by the Leukotriene Synthesis Inhibitor BAY X1005: Importance of Transcellular Biosynthesis of Cysteinyl-Leukotrienes," *J. Pharmacol. Exp. Therapeutics*, 276:335-341 (1996).
Royal et al., "Changing the Paradigm from 'Race' to Human Genome Variation," *Nat. Genet.*, 36:S5-7 (2004).
Rybina et al., "Alteration of Human Leukotriene A4 Hydrolase Activity After Site-Directed Mutagenesis: Serine-415 is a Regulatory Residue," *Biochim. Biophys. ACTA*, 1438:199-203 (1999).
Saito et al., "XXX5. Multicenter Randomised Clinical Trial of Ebselen with Aneurysmal Subarachnoid Hemorrhage," *J. Cerebral Blood Flow and Metabolism*, 15:S162 (1995).
Sala et al., "Leukotrienes: Lipid Bioeffectors of Inflammatory Reactions," *Biochemistry*, 63:84-92 (1998).
Sala et al., "Monoclonal Anti-CD18 Antibody Prevents Transcellular Biosynthesis of Cysteinyl Leukotrienes In Vitro and In Vivo and Protects Against Leukotriene-Dependent Increase in Coronary Vascular Resistance and Myocardial Stiffness," Circulation, 101:1436-1440 (2000).
Sampson, "Leukotrienes in Cardiovascular Disease", *Clinical and Experimental Allergy Review*, 1:170-174 (2001).
Schwartz et al., "Phase I and Pharmacokinetic Study of LY293111, an Orally Available Small Molecule known to be an LTB4 Receptor Antagonist, 5-Lipoxygenase Inhibitor and Peroxisome Proliferator Activated Receptor-Gamma Agonist (PPAR )," Abstract No. 343,2002 ASCO Annual Meeting.
Shepherd, "Economics of Lipid Lowering in Primary Prevention: Lessons from the West of Scotland Coronary Prevention Study," *Am. J. Cardiol.*, 87 (suppl):19B-22B (2001).
Showell et al., "The Preclinical Pharmacological Profile of the Potent and Selective Leukotriene B4 Antagonist CP-195543," *JPET*, 285:946-954 (1998).
Sigurdsson et al., "Long-Term Prognosis of Different Forms of Coronary Heart Disease: The Reykjavik Study," *Int. J. Epidem.*, 24-58-68 (1995).
Sigurdsson et al., "Silent ST-T Changes in an Epidemiologic Cohort Study—A Marker of Hypertension or Coronary Heart Disease, or Both: The Reykjavik Study," *J. Am. Coll. Cardiol.*, 27:1140-1147 (1996).
Smilde et al., "Effect of Aggressive Versus Conventional Lipid Lowering on Atherosclerosis Progression in Familial Hypercholesterolaemia (ASAP): A Prospective, Randomised, Double-Blind Trial," *Lancet*, 357:577-581 (2001).
Smith et al., "A High-Density Admixture Map for Disease Gene Discovery in African Americans," *Am. J. Hum. Genet.*, 74:1001-1013 (2004).
Spanbroek et al., "Expanding Expression of the 5-Lipoxygenase Pathway within the arterial Wall During Human Atherogenesis," *PNAS USA*, 100:1238-1243 (2003).
Stein, "Laboratory Surrogates for Anti-Atherosclerotic Drug Development," *Am. J. Cardio.*, 87:21A-26A (2001).
Steinhilber, "5-Lipoxygenase: A Target for Antiinflammatory Drugs Revisited," *Curr. Med. Chem.*, 5:71-85 (1999).
Subbarao et al., "Role of Leukotriene B4 Receptors in the Development of Atherosclerosis: Potential Mechanisms," *Arterioscler. Thromb. Vasc. Biol.*, 24:369 (2003).

Takase, "Change of Plasma Leukotriene C4 During Myocardial Ischemia in Humans," *Clin. Cardiol.*, 19:198-204 (1996).
Tang et al., "Genetic Structure, Self-Identified Race/Ethnicity, and Confounding in Case-Control Association Studies," *Am. J. Hum. Gen.*, 76:268-275 (2005).
Taubes, "Does Inflammation Cut to the Heart of the Matter?" *Science*, 296:242-245 (2002).
Terwilliger et al., "A Haplotype-Based 'Haplotype Relative Risk' Approach to Detecting Allelic Associations," *Hum Hered.*, 42:337-346 (1992).
The International HapMap Project, A Haplotype Map of the Human Genome, *Nature* 426:789-796 (2003).
The SNP Consortium Ltd., "SNP Report for TSC0806241," *Gene sequence*, (rs1323898), Oct. 10, 2000.
Thunnissen et al., "Crystal Structure of Human Leukotriene A4 Hydrolase, a Bifunctional Enzyme in Inflammation," *Nat. Struct. Biol.*, 8:131-135 (2001).
Thunnissen et al., "Crystal Structures of Leukotriene A4 Hydrolase in Complex with Captopril and Two Competitive Tight-Binding Inhibitors," *FASEB Journal*, 16:1648-1650 (2002).
Tracy, "Inflammation in Cardiovascular Disease. Cart, Horse or Both Revisited," *Arterioscler. Thromb. Vasc. Biol.*, 22:1514-1515 (2002).
Tselepis et al., "Inflammation, Bioactive Lipids and Atherosclerosis: Potential Roles of a Lipoprotein-Associated Phospholipase A2, Platelet Activating Factor-Acetylhydrolase," *Artheroscler. Suppl.*, 3:57-68 (2002).
Tunstall-Pedoe et al., "The World Health Organization Monica Project (Monitoring Trends and Determinants in Cardiovascular Disease): A Major International Collaboration," *J. Clin. Epidemiol.*, 41:105-114 (1988).
Verma et al., "A Self-Fulfilling Prophecy. C-Reactive Protein Attenuates Nitric Oxide Production and Inhibits Angiogenesis," *Circulation*, 106:913-919 (2002).
Walter et al., "Benefits of Immediate Initiation of Statin Therapy Following Successful Coronary Stent Implantation in Patients with Stable and Unstable Angina Pectoris and Q-Wave Acute Myocardial Infarction,", *Am. J. Cardiol.*, 89:1-6 (2002).
Wang et al., "Association of C-Reactive Protein With Carotid Atherosclerosis in Men and Women: The Framingham Heart Study," *Arterioscler. Thromb. Vasc. Biol.*, 22:1662-1667 (2002).
Waters et al., "Effects of Atorvastatin on Stroke in Patients with Unstable Angina or Non-Q-Wave Myocardial Infarction. A Myocardial Ischemia Reduction with Aggressive Cholesterol Lowering (MIRACL) Substudy," *Circulation*, 106:1690-1695 (2002).
Wetterholm et al., "Leukotriene A4 Hydrolase: Abrogation of the Peptidase Activity by Mutation of Glutamic Acid-296," *Proc. Natl. Acad. Sci.*, 89:9141-9145 (1992).
Whalley et al., "Cognitive Aging, Childhood Intelligence, and the Use of Food Supplements: Possible Involvement of n-3 Fatty Acids: Possible Involvement of n-3 Fatty Acids," *Am. J. Clin. Nutr.*, 80:1650-1657 (2004).
Whittemore et al, "A Class of Tests for Linkage Using Affected Pedigree Members," *Biometrics*, 50:118-127 (1994).
Willerson et al., "Protection of the Myocardium During Myocardial Infarction: Pharmacologic Protection During Thrombolytic Therapy," *Am. J. Cardio.*, 65:35 I-41 I (1990).
Written Opinion of the International Searching Authority for International Application No. PCT/US2004/030582.
Yamada et al., "Prediction of the Risk of Myocardial Infarction from Polymorphisms in Candidate Genes," *N. Eng. J. Med.*, 347:1916-1923 (2002).
Yee et al., "Practical Synthesis of an Enantiomerically Pure trans-4,5-Disubstituted 2-Pyrrolidinone via Enzymatic Resolution. Preparation of the LTB4 Inhibitor BIRZ-227," *J. Org. Chem.*, 63:326-330 (1998).
Yokomizo et al., "cDNA Cloning, Expression, and Mutagenesis Study of Leukotriene B4 12-Hydroxydehydrogenase," *J. Biol. Chem.*, 271:2844-2850 (1996).
Zhang et al., "Association Between Myeloperoxidase Levels and Risk of Coronary Artery Disease," *JAMA*, 286:2136-2142 (2001).
Zhao et al., "The 5-Lipoxygenase Pathway Promotes Pathogenesis of Hyperlipidemia-Dependent Aortic Aneurysm," *Nat. Med.*, 10:966-973 (2004).

Crosslin et al., Genetic effects in the leukotriene biosynthesis pathway and association with atherosclerosis. *Hum. Genet.* 125: 217-229 (2009).

Genbank Accession No. Z24370, *Homo sapiens* (D13S289) DNA segment containing (CA) repeat; clone AFM321xb1; single read, Nov. 28, 1994.

Genbank Accession No. Z52271, *Homo sapiens* (D13S1238) DNA segment containing (CA) repeat; clone AFMa142zb5; single read, sequence tagged site, Sep. 9, 2004.

* cited by examiner

METHODS OF DIAGNOSING SUSCEPTIBILITY TO MYOCARDIAL INFARCTION AND SCREENING FOR AN LTA4H HAPLOTYPE

This application is a continuation-in-part of U.S. patent application Ser. No. 11/096,191, filed Mar. 30, 2005 (now abandoned), which is incorporated herein by reference in its entirety.

The file copy of the sequence listing is submitted on a Compact-Disc Read Only Memory (CD-ROM). Three copies of the CD-ROM are submitted (denoted as Copy 1, Copy 2 and CRF) and the content of the 3 submitted CD-ROMs are identical. The sequence listing is saved on each CD-ROM as an ASCII text file named 40807.txt (571 kB), which was created on Nov. 8, 2005. The contents of each CD-ROM are incorporated herein by reference in its entirety.

BACKGROUND OF THE INVENTION

Myocardial infarction (MI) and Acute Coronary Syndrome (ACS), e.g., unstable angina, non-ST-elevation myocardial infarction (NSTEMI) or ST-elevation myocardial infarction (STEMI), are the leading causes of hospital admissions in industrialized countries. Cardiovascular disease continues to be the principle cause of death in the United States, Europe and Japan. The costs of the disease are high both in terms of morbidity and mortality, as well as in terms of the financial burden on health care systems.

Myocardial infarction generally occurs when there is an abrupt decrease in coronary blood flow following a thrombotic occlusion of a coronary artery previously damaged by atherosclerosis. In most cases, infarction occurs when an atherosclerotic plaque fissures, ruptures or ulcerates and when conditions favor thrombogenesis. In rare cases, infarction may be due to coronary artery occlusion caused by coronary emboli, congenital abnormalities, coronary spasm, and a wide variety of systemic, particularly inflammatory diseases. Medical risk factors for MI include cigarette smoking, diabetes, hypertension and serum total cholesterol levels >200 mg/dL, elevated serum LDL cholesterol, and low serum HDL cholesterol. Event rates in individuals without a prior history of cardiovascular disease are about 1%. In individuals who have had a first MI or ACS, the risk of a repeat MI within the next year is 10-14%, despite maximal medical management including angioplasty and stent placement.

Cardiovascular disease is one of the primary causes of death among African Americans and over 4 in every 10 non-Hispanic black adults have CVD, including myocardial infarction, stroke and congestive heart failure (American Heart Association, 2005 statistics). Race-based therapeutics are emerging to treat populations of human patients that are at a high risk based on their race. For example, BiDil (isosorbide dinitrate hydralazine hydrochloride) is currently approved for treatment of heart failure in self-identified black patients to improve survival, to prolong time to hospitalization for heart failure, and to improve patient-reported functional status. In addition, U.S. Pat. No. 6,465,463 purports to describe methods of reducing mortality associated with heart failure in black patients comprising administering to these patients hydralazine compounds in combination with isosorbide dinitrate or isosorbide mononitrate.

Although self-reporting is an effective way to identify race, ethnic ancestry and other family and medical history information that may be relevant to medical diagnosis and treatment, it is imperfect. A need exists for improved tools, especially genetic tools, to more reliably correlate patients with medical risks and susceptibilities. This may especially be true in the United States and other countries that are apt to have people of mixed ancestry.

Atherosclerosis can affect vascular beds in many large and medium arteries. Myocardial infarction and unstable angina (acute coronary syndrome (ACS)) stem from coronary artery atherosclerosis, while ischemic stroke most frequently is a consequence of carotid or cerebral artery atherosclerosis. Limb ischemia caused by peripheral arterial occlusive disease (PAOD) may occur as a consequence of iliac, femoral and popliteal artery atherosclerosis. The atherosclerotic diseases remain common despite the wide-spread use of medications that inhibit thrombosis (aspirin) or treat medical risk factors such as elevated cholesterol levels in blood (statins), diabetes, or hypertension (diuretics and anti-hypertensives).

Atherosclerotic disease is initiated by the accumulation of lipids within the artery wall, and in particular, the accumulation of low-density lipoprotein (LDL) cholesterol. The trapped LDL becomes oxidized and internalized by macrophages. This causes the formation of atherosclerotic lesions containing accumulations of cholesterol-engorged macrophages, referred to as "foam cells". As disease progresses, smooth muscle cells proliferate and grow into the artery wall forming a "fibrous cap" of extracellular matrix enclosing a lipid-rich, necrotic core. Present in the arterial walls of most people throughout their lifetimes, fibrous atherosclerotic plaques are relatively stable. Such fibrous lesions cause extensive remodeling of the arterial wall, outwardly displacing the external, elastic membrane, without reduction in luminal diameter or serious impact on delivery of oxygen to the heart. Accordingly, patients can develop large, fibrous atherosclerotic lesions without luminal narrowing until late in the disease process. However, the coronary arterial lumen can become gradually narrowed over time and in some cases compromise blood flow to the heart, especially under high demand states such as exercise. This can result in reversible ischemia causing chest pain relieved by rest called stable angina.

In contrast to the relative stability of fibrous atherosclerotic lesions, the culprit lesions associated with myocardial infarction and unstable angina (each of which are part of the acute coronary syndrome) are characterized by a thin fibrous cap, a large lipid core, and infiltration of inflammatory cells such as T-lymphocytes and monocyte/macrophages. Non-invasive imaging techniques have shown that most MI's occur at sites with low- or intermediate-grade stenoses, indicating that coronary artery occlusion is due most frequently to rupture of culprit lesions with consequent formation of a thrombus or blood clot and not solely due to luminal narrowing by stenosis. Plaque rupture may be due to erosion or uneven thinning of the fibrous cap, usually at the margins of the lesion where macrophages enter, accumulate, and become activated by a local inflammatory process. Thinning of the fibrous cap may result from degradation of the extracellular matrix by proteases released from activated macrophages. These changes producing plaque instability and risk of MI may be augmented by production of tissue-factor procoagulant and other factors increasing the likelihood of thrombosis.

In acute coronary syndrome, the culprit lesion showing rupture or erosion with local thrombosis typically is treated by angioplasty or by balloon dilation and placement of a stent to maintain luminal patency. Patients experiencing ACS are at high risk for a second coronary event due to the multi-vessel nature of coronary artery disease with event rates approaching 10-14% within 12 months after the first incident.

The emerging view of MI is as an inflammatory disease of the arterial vessel wall on preexisting chronic atherosclerotic lesions, sometimes triggering rupture of culprit lesions and leading to local thrombosis and subsequent myocardial infarction. The process that triggers and sustains arterial wall inflammation leading to plaque instability is unknown, however, it results in the release into the circulation of tumor necrosis factor alpha and interleukin-6. These and other cytokines or biological mediators released from the damaged vessel wall stimulate an inflammatory response in the liver causing elevation in several non-specific general inflammatory markers including C-reactive protein. Although not specific to atherosclerosis, elevated C-reactive protein (CRP) and serum amyloid A appear to predict risk for MI, perhaps as surrogates for vessel wall inflammation.

Although classical risk factors such as smoking, hyperlipidemia, hypertension, and diabetes are associated with many cases of coronary heart disease (CHD) and MI, many patients do not have involvement of these risk factors. In fact, many patients who exhibit one or more of these risk factors do not develop MI. Family history has long been recognized as one of the major risk factors. Although some of the familial clustering of MI reflects the genetic contribution to the other conventional risk factors, a large number of studies have suggested that there are significant genetic susceptibility factors, beyond those of the known risk factors (Friedlander Y, et al., *Br. Heart J.* 1985; 53:382-7, Shea S. et al., *J. Am. Coll. Cardiol.* 1984; 4:793-801, and Hopkins P. N., et al., *Am. J. Cardiol.* 1988; 62:703-7). Major genetic susceptibility factors have only been identified for the rare Mendelian forms of hyperlipidemia such as a familial hypercholesterolemia.

Genetic risk is conferred by subtle differences in genes among individuals in a population. Genes differ between individuals most frequently due to single nucleotide polymorphisms (SNP), although other variations are also important. SNP are located on average every 1000 base pairs in the human genome. Accordingly, a typical human gene containing 250,000 base pairs may contain 250 different SNP. Only a minor number of SNP are located in exons and alter the amino acid sequence of the protein encoded by the gene. Most SNP have no effect on gene function, while others may alter transcription, splicing, translation, or stability of the mRNA encoded by the gene. Additional genetic polymorphism in the human genome is caused by insertion, deletion, translocation, or inversion of either short or long stretches of DNA. Genetic polymorphisms conferring disease risk may therefore directly alter the amino acid sequence of proteins, may increase the amount of protein produced from the gene, or may decrease the amount of protein produced by the gene.

As genetic polymorphisms conferring risk of disease are uncovered, genetic testing for such risk factors is becoming important for clinical medicine. Examples are apolipoprotein E testing to identify genetic carriers of the apoE4 polymorphism in dementia patients for the differential diagnosis of Alzheimer's disease, and of Factor V Leiden testing for predisposition to deep venous thrombosis. More importantly, in the treatment of cancer, diagnosis of genetic variants in tumor cells is used for the selection of the most appropriate treatment regime for the individual patient. In breast cancer, genetic variation in estrogen receptor expression or heregulin type 2 (Her2) receptor tyrosine kinase expression determine if anti-estrogenic drugs (tamoxifen) or anti-Her2 antibody (Herceptin) will be incorporated into the treatment plan. In chronic myeloid leukemia (CML) diagnosis of the Philadelphia chromosome genetic translocation fusing the genes encoding the Bcr and Abl receptor tyrosine kinases indicates that Gleevec (STI571), a specific inhibitor of the Bcr-Abl kinase should be used for treatment of the cancer. For CML patients with such a genetic alteration, inhibition of the Bcr-Abl kinase leads to rapid elimination of the tumor cells and remission from leukemia.

Many general inflammatory markers predict risk of coronary heart disease, although these markers are not specific to atherosclerosis. For example, Stein (Stein, S., *Am J Cardiol*, 87 (suppl):21A-26A (2001)) discusses the use of any one of the following serum inflammatory markers as surrogates for predicting risk of coronary heart disease including C-reactive protein (CRP), serum amyloid A, fibrinogen, interleukin-6, tissue necrosis factor-alpha, soluble vascular cell adhesion molecules (sVCAM), soluble intervascular adhesion molecules (sICAM), E-selectin, matrix metalloprotease type-1, matrix metalloprotease type-2, matrix metalloprotease type-3, and matrix metalloprotease type-9. Elevation in one more of these serum inflammatory markers is not specific to coronary heart disease but also occurs with age or in association with cerebrovascular disease, peripheral vascular disease, non-insulin dependent diabetes, osteoarthritis, bacterial infection, and sepsis.

Serum C-reactive protein (CRP) is viewed as a convenient and sensitive marker of systemic inflammation. Generally CRP is measured in serum samples using commercially available enzyme-linked immunosorbent assays (EIA). Consistent across multiple published studies is the finding of a correlation between increased risk for coronary artery disease with increased serum CRP. For example, in the Women's Health Study, CRP was measured in 27,939 apparently healthy American women. The cut-off points for quintiles of serum CRP in women were: less than or equal to 0.49, more than 0.49 to 1.08, more than 1.08 to 2.09, more than 2.09 to 4.19, and more than 4.19 mg CRP per liter, see Ridker, P. M. et al., *New England. J. Med.,* 347: 1557-1565 (2001). In comparison to the lowest quintile, and even when adjusting for age, every quintile more than 0.49 mg CRP per liter was associated with increased risk for coronary heart disease with the highest relative risk of 4.5 seen for those women in the highest quintile of serum CRP (more than 4.19 mg CRP per liter). A similar correlation between increased serum CRP and increased risk for coronary heart disease in women has been reported (Ridker, P. M et al., *New Engld. J. Med.,* 342:836-843 (2000) and Bermudez, E. A. et. al., *Arterioscler. Thromb. Vasc. Biol.,* 22: 1668-1673 (2002)). Men also show a correlation between increased serum inflammatory markers such as CR and increased risk for coronary heart disease has been reported (Doggen, C. J. M. et al., *J. Internal Med.,* 248:406-414 (2000) and Ridker, P. M. et al., *New England. J. Med.,* 336: 973-979 (1997)). Quintiles for serum CRP as reported by Doggen et al., were less than 0.65, more than 0.65 to 1.18, more than 1.18 to 2.07, more than 2.07 to 4.23, and more than 4.23 mg CRP per liter. Unlike women, elevated serum CRP correlates with increased relative risk for coronary heart disease only in the $4^{th}$ and $5^{th}$ quintiles of CRP (relative risk of 1.7× and 1.9×, respectively).

Serum CRP in women also has been measured in conjunction with lipid markers such as levels of serum low density lipoprotein-cholesterol (LDL-C). In the study by Ridker, P. M. et al. (2002), serum CRP and LDL-C are minimally correlated, screening for both serum markers provided better prognostic indication than either alone. Thus, women with serum CRP above median values (more than 1.52 mg CRP per liter) and also serum LDL-C above median values (more than 123.7 mg LDL-C per deciliter) were at highest risk for coronary heart disease.

Elevated CRP or other serum inflammatory markers is also prognostic for increased risk of a second myocardial infarct in patients with a previous myocardial infarct (Retterstol, L. et al., *Atheroscler.*, 160: 433-440 (2002)).

Since CRP is produced in the liver, there is no a priori mechanistic explanation for why elevation in CRP and other serum inflammatory markers should be prognostic for coronary artery disease. As discussed by Doggen, C. J. M., et al., one or more of the following factors were speculated to account for the correlation observed: (1) intrinsic inflammation and tissue damage within arterial lesions, (2) prior infection by *Helicobacter pylori* or by *Chlamydia pneumoniae*, (3) release of peptide cytokines including interleukin-6, or (4) activation of the complement system.

The end products of the leukotriene pathway are potent inflammatory lipid mediators derived from arachidonic acid. They can potentially contribute to development of atherosclerosis and destabilization of atherosclerotic plaques through lipid oxidation and/or proinflammatory effects. LTC4, LTD4, and LTE4, are known to induce vasoconstriction. Allen et al., *Circulation*, 97:2406-2413 (1998) described a novel mechanism in which atherosclerosis is associated with the appearance of a leukotriene receptor(s) capable of inducing hyperactivity of human epicardial coronary arteries in response to LTC4 and LTD4. LTB4, on the other hand, is a strong proinflammatory agent. Increased production of these end products, of the leukotriene pathway, could therefore serve as a risk factor for MI and atherosclerosis, whereas both inflammation and vasoconstriction/vasospasm have a well established role in the pathogenesis of MI and atherosclerosis. It has also been shown that a heterozygous deficiency of the 5-LO enzyme in a knockout mouse model decreases atherosclerotic lesion size in LDLR–/– mice by about 95%. (Mehrabian et al., *Circulation Research*. 91:120 (2002)). However, such genetic evidence for leukotriene involvement in MI or atherosclerosis in humans has not been reported. Mehrabian et al. did report a very small genetic association study looking for correlation between promoter polymorphisms of 5-LO and carotid intimal thickening in normal individuals (Dwyer et al. *New England Journal of Medicine*, 350: 29-37, 2004). However, their data paradoxically suggest that a lower amount of leukotriene production correlates with carotid atherosclerosis.

SUMMARY OF THE INVENTION

As described herein, a gene on chromosome 13q12-13 has been identified as playing a major role in myocardial infarction (MI). This gene, herein after referred to as the MI gene, comprises nucleic acid that encodes 5-lipoxygenase activating protein (ALOX5AP or FLAP) herein after referred to as FLAP. The gene has also been shown to play a role in stroke and PAOD. In addition, a gene on chromosome 12q23 has been identified as playing a major role in myocardial infarction (MI). The gene comprises nucleic acid that encodes leukotriene A4 hydrolase, herein after referred to as LTA4H.

One aspect of the invention includes materials and methods for identifying or diagnosing a person or screening for increased risk (susceptibility) to MI or other conditions based on FLAP and/or LTA4H markers that can be assayed from their DNA or RNA. For example, in some embodiments, the invention is a method of screening a human subject for susceptibility or elevated risk for MI or other adverse cardiovascular events by assaying nucleic acid from the subject for one or more polymorphisms, markers, haplotypes, alleles or genotypes, and assaying or predicting the presence or absence of the susceptibility or elevated risk from the presence or absence or identity of the polymorphisms, markers, haplotypes, etc. that are assayed. Numerous FLAP and LTA4H embodiments are described below in greater detail.

The invention also pertains to methods of treatment (prophylactic and/or therapeutic) for certain diseases and conditions (e.g., MI, ACS, atherosclerosis, stroke, PAOD) associated with FLAP or with other members of the leukotriene pathway (e.g., biosynthetic enzymes or proteins such as FLAP, arachidonate 4-lipoxygenase (5-LO), leukotriene C4 synthase (LTC4S), leukotriene A4 hydrolase (LTA4H), leukotriene B4 12-hydroxydehydrogenase (LTB4DH)); receptors and/or binding agents of the enzymes; and receptors for the leukotrienes LTA4, LTB4, LTC4, LTD4, LTE4, Cys LT1, Cys LT2, including leukotriene B4 receptor 1 (BLT1), leukotriene B4 receptor 2 (BLT2), cysteinyl leukotriene receptor 1 (CysLTR1), cysteinyl leukotriene receptor 2 (CysLTR2). The methods include the following: methods of treatment for myocardial infarction or susceptibility to myocardial infarction; methods of phophylaxis therapy for myocardial infarction; methods of treatment for transient ischemic attack, transient monocular blindness or stroke, or susceptibility to stroke; methods of treatment for claudication, PAOD or susceptibility to PAOD; methods of treatment for acute coronary syndrome (e.g., unstable angina, non-ST-elevation myocardial infarction (NSTEMI) or ST-elevation myocardial infarction (STEMI)); methods for reducing risk of MI, stroke or PAOD in persons with asymptomatic ankle/brachial index less than 0.9; methods for decreasing risk of a second myocardial infarction or stroke; methods of treatment for atherosclerosis, such as for patients requiring treatment (e.g., angioplasty, stents, revascularization procedure) to restore blood flow in arteries (e.g., coronary, carotid, and/or femoral arteries); methods of treatment for asymptomatic ankle/brachial index of less than 0.9; and/or methods for decreasing leukotriene synthesis (e.g., for treatment of myocardial infarction, stroke or PAOD).

The invention provides for methods of prophylaxis therapy for myocardial infarction (MI). These methods comprise selecting a human subject susceptible to MI, administering to the subject a composition comprising a therapeutically effective amount of an MI therapeutic agent that inhibits leukotriene synthesis in vivo, wherein the MI therapeutic agent inhibits leukotriene synthesis by inhibiting the activity of at least one protein selected from 5-Lipoxygenase activating protein (FLAP) and 5-lipoxygenase (5-LO). The methods also (optionally) comprise monitoring myeloperoxidase level before and during the prophylaxis treatment, wherein the MI therapeutic agent is administered in an amount effective to reduce MPO levels in a subject. These methods may further comprise monitoring at least one additional or alternative inflammatory marker, such as C-reactive protein, in the human subject before and during the prophylaxis therapy.

In some methods of the invention, a leukotriene synthesis inhibitor is administered to an individual in a therapeutically effective amount. The leukotriene synthesis inhibitor can be an agent that inhibits or antagonizes a member of the leukotriene synthesis pathway (e.g., FLAP, 5-LO, LTC4S, LTA4H, and LTB4DH). For example, the leukotriene synthesis inhibitor can be an agent that inhibits or antagonizes FLAP polypeptide activity (e.g., a FLAP inhibitor) and/or FLAP nucleic acid expression, as described herein (e.g., a FLAP nucleic acid antagonist). In another embodiment, the leukotriene synthesis inhibitor is an agent that inhibits or antagonizes polypeptide activity and/or nucleic acid expression of another member of the leukotriene biosynthetic pathway (e.g., LTC4S, LTA4H) or that increases breakdown of leukotrienes (e.g., LTB4DH). In preferred embodiments, the agent alters activity and/or nucleic acid expression of FLAP or of 5-LO. Preferred agents include those set forth in the Agent Table I herein. In another embodiment, preferred agents can be: 1-((4-chlorophenyl)methyl)-3-((1,1-dimethylethyl)thio)-alpha,alpha-dimethyl-5-(2-quinolinylmethoxy)-1H-Indole-2-propanoic acid otherwise known as MK-0591, (R)-(+)-alpha-cyclopentyl-4-(2-quinolinylmethoxy)-Benzeneacetic acid otherwise known as BAY-x-1005, 3-(3-(1,1-dimethyl-ethylthio-5-(quinoline-2-ylmethoxy)-1-(4-chlorometh-ylphenyl)indole-2-yl)-2,2-dimethylpropionaldehyde oxime-0-2-acetic acid otherwise known as A-81834, optically pure enantiomers, salts, chemical derivatives, and analogues; or can be zileuton, atreleuton, 6-((3-fluoro-5-(tetrahydro-4-methoxy-2H-pyran-4yl)phenoxy)methyl)-1-methyl-2(1H)-quinlolinone otherwise known as ZD-2138, 1-((4-chlorophe-nyl)methyl)-3-((1,1dimethylethyl)thio)-alpha,alpha-dimethyl-5-(2-quinolinylmethoxy)-1H-Indole-2-propanoic acid otherwise known as MK-886, 4-(3-(4-(2-Methyl-imida-zol-1-yl)-phenylsulfanyl)-phenyl)-tetrahydro-pyran-4-car-boxylic acid amide otherwise known as CJ-13610, their optically pure enantiomers, salts, chemical derivatives, and analogues. In another embodiment, the agent alters metabolism or activity of a leukotriene (e.g., LTA4, LTB4, LTC4, LTD4, LTE4, Cys LT1, Cys LT2), such as leukotriene antagonists or antibodies to leukotrienes, as well as agents which alter activity of a leukotriene receptor (e.g., BLT1, BLT2, CysLTR1, and CysLTR2).

In other preferred embodiments, the agent alters activity and/or nucleic acid expression of LTA4H. Preferred agents include those set forth in the Agent Table II and in the Additional LTA4H Agent List herein. In another embodiment, preferred agents can be: ethyl-1-[2-[4-(phenylmethyl)phe-noxy]ethyl]-4-piperidine-carboxylate, otherwise known as SC-56938; [4-[5-(3-Phenyl-propyl)thiophen-2-yl]butoxy] acetic acid, otherwise known as RP64966; (R)-S-[[4-(dim-ethylamino)phenyl]methyl]-N-(3-mercapto-2methyl-1-oxo-propyl-L-cycteine, otherwise known as SA6541; optically pure enantiomers, salts, chemical derivatives, and analogues.

The results in Example 10 demonstrate that in patients with the at-risk FLAP and $LTA_4$ haplotypes, a FLAP inhibitor (DG-031 also known as Bay-X-1005) had a highly significant and dose-dependent effect at the cellular, whole bood and urinary metabolite level including a 26% reduction in leukotriene $B_4$ production by activated neutrophils, a 13% reduction of myeloperoxidase in whole blood, and a 27% increase in urinary leukotriene $E_4$. Furthermore, there was evidence of a persistent effect, following discontinuation of the FLAP inhibitor, on high senstivity C-reactive protein and serum amyloid A. This reduction in CRP and serum amyloid A was observed on top of the beneficial effects that may have been acheived by statins taken by 85% of the study subjects.

The invention includes compositions comprising a leukotriene synthesis inhbitor and a statin. The invention also includes the use of a leukotriene synthesis inhibitor and a statin for the manufacture of a medicament for reducing CRP levels in a human subject. Such compositions are intended for human administration, and preferably further comprise a (at least one) pharmaceutically acceptable diluent, adjuvant, excipient, or carrier. Materials and methods for formulation and co-formulation are well known, and many are described herein in greater detail. In one variation, formulation of the composition into convenient unit dose formulations, such as pills or capsules for oral administration, including sustained release formulations, is specifically contemplated. In another variation, co-administration transdermally, e.g., through a skin patch, is contemplated. In still another variation, administration of one or both agents through a drug eluting stent is specifically contemplated. In particular, the compositions may comprises a leukotriene synthesis inhibitor that inhibits the activity of a member of the leukotriene synthesis pathway such as 5-lipoxygenase, 5-lipoxygenase activating protein (FLAP), leutokriene C4 synthase, leukriene A4 hydolase, arachidonate 4-lipoxygenase, leukotriene B4 12-hydroxyde-hydrogenase, leukotriene A4 receptor, leukotriene B4 receptor, leukotriene C4 receptor, leukotriene D4 receptor, leukotriene E4 receptor, leukotriene B4 receptor 1, leukotriene B4 receptor 2, cysteinyl leukotriene receptor 1 and cysteinyl leukotriene receptor 2. Any LT inhibitor is suitable for practice of the invention, and several LT inhibitors are described herein. To help minimize side effects, an LT inhibitor that is specific for a member of the LT synthesis pathway is preferred. Exemplary inhibitors include both small molecules, biological inhibitors of proteins, (e.g., antibody substances, peptides), and biological inhibitors that operate at the nucleic acid level (e.g., antisense nucleic acids and interfering RNA nucleic acids and zinc finger proteins).

Preferred agents that inhibit the activity of a member of the leukotriene pathway are listed in the Agent Table I herein, including the following agents: 1-((4-chlorophenyl)methyl)-3-((1,1-dimethylethyl)thio)-alpha,alpha-dimethyl-5-(2-quinolinylmethoxy)-1H-Indole-2-propanoic acid, (R)-(+)-alpha-cyclopentyl-4-(2-quinolinylmethoxy)-Benzeneacetic acid, 3-(3-(1,1-dimethylethylthio-5-(quinoline-2-yl-methoxy)-1-(4-chloromethylphenyl)indole-2-yl)-2,2-dimethylpropionaldehyde oxime-0-2-acetic acid, zileuton, atreleuton, 6-((3-fluoro-5-(tetrahydro-4-methoxy-2H-pyran-4yl)phenoxy)methyl)-1-methyl-2(1H)-quinlolinone, 1-((4-chlorophenyl)methyl)-3-((1,1dimethylethyl)thio)-alpha,alpha-dimethyl-5-(2quinolinylmethoxy)-1H-Indole-2-propanoic acid and 4-(3-(4-(2-Methyl-imidazol-1-yl)-phenylsulfanyl)-phenyl)-tetrahydro-pyran-4-carboxylic acid amide. In one variation, the LT inhibitor is an inhibitor of FLAP. One preferred group of compounds are described herein as BAY X1005 (also known as DG-031) as well as related compounds described in Mohrs et al., U.S. Pat. No. 4,970,215, incorporated herein by reference in its entirety. In another variation, the LT inhibitor is a LTA4H inhibitor. Other preferred agents include those set forth in the Agent Table II and the LTA4H Agent list set out herein. Additional preferred agents include those described in Penning et al., *Med Chem.* 2002 45(16):3482-90, Penning, *Curr Pharm Des.* 2001, 7(3): 163-79 and Penning et al., *J Med Chem.* 2000 43(4):721-35.

AGENT TABLE II

| Target | Compound ID | Chemical Name | Patent/Reference |
| --- | --- | --- | --- |
| LTA4H Inhibitor | SC-57461A | 3-[methyl[3-[4-(phenylmethyl)phenoxy]-propyl]amino]propionic acid | Penning, T. D. et. al. Bioorg Med. Chem. Letters (2003), 13, 1137-1139. Penning, T. D. et. al. Bioorg Med. Chem. Letters, (2002), 12, 3383-3386 |
| LTA4H Inhibitor | SC-56938 | Ethyl-1-[2-[4-(phenylmethyl)phenoxy]ethyl]-4-piperidine- | Penning, T. D. et. al. Bioorg Med. Chem. Letters (2003), 13, 1137-1139. Penning, T. D. et. al. Bioorg Med. |

AGENT TABLE II-continued

| Target | Compound ID | Chemical Name | Patent/Reference |
|---|---|---|---|
| | | carboxylate | Chem. Letters, (2002), 12, 3383-3386. U.S. Pat. No. 6,506,87 6A1 |
| LTA4H Inhibitor | RP 64966 | [4-[5-(3-Phenyl-propyl)thiophen-2-yl]butoxy]acetic acid | WO9627585 |
| LTA4H Inhibitor | SA 6541 | (R)-S-[[4-(dimethylamino)phenyl]methyl]-N-(3-mercapto-2methyl-1-oxopropyl-L-cycteine | WO9809943 |
| LTA4H Inhibitor | SA-9499/ SA-6541 | (R)-3-(4-Dimethylamino-benzylsulfanyl)-2-((R)-3-mercapto-2-methyl-propionylamino)-propionic acid | |
| LTB4 Receptor Antagonist | Amelubant/ BIIL-284 | Carbamic acid,((4-((3-((4-(1-(4-hydroxyphenyl)-1-methylethyl)phenoxy)methyl)phenyl)methoxy)phenyl)iminomethyl)-ethyl ester | U.S. Pat. No. 6,576,669 |
| LTB4 Receptor Antagonist | BIRZ-227 | 5-Chloro-2-[3-(4-methoxy-phenyl)-2-pyridin-2-yl-pyrrolidin-1-yl]-benzooxazole | Journal of Organic Chemistry 1998, 63: 2(326-330). |
| LTB4 Receptor Antagonist | CP 195543 | 2-[(3S,4R)-3,4-dihydro-4-hydroxy-3-(phenylmethyl)-2H-1-benzopyran-7-yl]-4-(trifluoromethyl)benzoic acid | Process: WO 98/11085 1998, priority US 60/26372 1996; J. Pharamacology and Expert. Therapy, 1998, 285: 946-54 |
| LTB4 Receptor Antagonist | Ebselen | 2-Phenyl-benzo[d]isoselenazol-3-one | Journal of Cerebral Blood Flow and Metabolism 1995, July 2-6 (S162); Drugs of the Future 1995, 20: 10 (1057) |
| LTB4 Receptor Antagonist | LTB 019; CGS-25019C | 4-[5-(4-Carbamimidoyl-phenoxy)-pentyloxy]-N,N-diisopropyl-3-methoxy-benzamide maleate | ACS Meeting 1994, 207th: San Diego (MEDI 003); International Congress of the Inflammation Research Association 1994, 7th: White Haven (Abs W23) |
| LTB4 Receptor Antagonist | LY 210073 | 5-(2-Carboxy-ethyl)-6-[6-(4-methoxy-phenyl)-hex-5-enyloxy]-9-oxo-9H-xanthene-2-carboxylic acid | J Med Chem 1993 36 (12) 1726-1734 |
| LTB4 Receptor Antagonist | LY 213024 | 5-(3-carboxybenzoyl)-2-(decyloxy)benzenepropanoic acid | J Med Chem 1993 36 (12) 1726-1734 |
| LTB4 Receptor Antagonist | LY 255283 | 1-[5-ethyl-2-hydroxy-4-[[6-methyl-6-(1H-tetrazol-5-yl)heptyl]oxy]phenyl]ethanone | EP 276064 B 1990, priority US 2479 1987 |
| LTB4 Receptor Antagonist | LY 264086 | 7-carboxy-3-(decyloxy)-9-oxo-9H-xanthene-4-propanoic acid | U.S. Pat. No. 4996230 1991, priority US 481413 1990 |
| LTB4 Receptor Antagonist | LY 292728 | 7-carboxy-3-[3-[(5-ethyl-4'-fluoro-2-hydroxy[1,1'-biphenyl]-4-yl)oxy]propoxy]-9-oxo-9H-xanthene-4-propanoic acid disodium salt | EP 743064 A 1996, priority US 443179 1995 |
| LTB4 Receptor Antagonist | LY-293111 (VML-295) | Benzoic acid,2-(3-(3-((5-ethyl-4'-fluoro-2-hydroxy(1,1'-biphenyl)-4-yl)oxy)propoxy)-2-propylphenoxy)- | Proceedings of the American Society for Clinical Oncology 2002, 21: 1 (Abs 343) [LY-293111 for Cancer] SCRIP World Pharmaceutical News 1997, 2272 (13) [for VML-295] |
| LTB4 Receptor Antagonist | ONO 4057; LB 457 | (E)-2-(4-carboxybutoxy)-6-[[6-(4-methoxyphenyl)-5-hexenyl]oxy]benzenepropanoic acid | EP 405116 A 1991 |
| LTB4 Receptor | PF 10042 | 1-[5-hydroxy-5-[8-(1-hydroxy-2-phenylethyl)- | EP 422329 B 1995, priority US 409630 1989 |

AGENT TABLE II-continued

| Target | Compound ID | Chemical Name | Patent/Reference |
|---|---|---|---|
| Antagonist | | 2-dibenzofuranyl]-1-oxopentyl]pyrrolidine | |
| LTB4 Receptor Antagonist | RG-14893 | 8-Benzyloxy-4-[(methyl-phenethyl-carbamoyl)-methyl]-naphthalene-2-carboxylic acid | SCRIP World Pharmaceutical News 1996, 2168 (20) |
| LTB4 Receptor Antagonist | SB-201993 | 3-{6-(2-Carboxy-vinyl)-5-[8-(4-methoxy-phenyl)-octyloxy]-pyridin-2-ylmethylsulfanylmethyl}-benzoic acid | WO-09500487 |
| LTB4 Receptor Antagonist | SC-52798 | 7-[3-(2-Cyclopropylmethyl-3-methoxy-4-thiazol-4-yl-phenoxy)-propoxy]-8-propyl-chroman-2-carboxylic acid | Bioorganic and Medicinal Chemistry Letters 1994, 4: 6 (811-816); Journal of Medicinal Chemistry 1995, 38: 6 (858-868) |
| LTB4 Receptor Antagonist | SC-53228 | 3-{7-[3-(2-Cyclopropylmethyl-3-methoxy-4-methylcarbamoyl-phenoxy)-propoxy]-8-propyl-chroman-2-yl}-propionic acid | International Congress of the Inflammation Research Association 1994, 7th: White Haven (Abs W5) |
| LTB4 Receptor Antagonist | WAY 121006 | 3-fluoro-4'-(2-quinolinylmethoxy)-[1,1'-biphenyl]-4-acetic acid | Drugs under Experimental and Clinical research 1991, 17: 8 (381-387) |
| LTB4 Receptor Antagonist | ZD-2138 | 3-Amino-3-(4-methoxy-tetrahydro-pyran-4-yl)-acrylic acid 1-methyl-2-oxo-1,2-dihydro-quinolin-6-ylmethyl ester | International Symposium on Medicinal Chemistry 1994, 13th: Paris (P 197) |

In addition the following LTA4H inhibitors are described in USP2003/0004101A1, the teachings of which are incorporated herein by reference in their entirety:

Additional LTA4H Agent List 1. 1-[2-[4-(phenylmethyl)phenoxy]ethyl]-2-methyl-4-tetrazolylpieridine
2. 1-[2-[4-(4-oxazolyl)phenoxy)phenoxy]ethyl]pyrrolidine
3. 3-[methyl[3-[4-(2-thienylmethyl)phenoxy]propyl]amino]propionic acid
4. methyl 3-[methyl[3-[4-(2-thienylmethyl)phenoxy]propyl]amino]propionate
5. 3-[methyl[3-[4-(3-thienylmethyl)phenoxy]propyl]amino]propionic acid
6. methyl-3-[methyl[3-4-(3-theinylmethyl)phenoxy]propyl]amino]propionate
7. 3-[methyl[3-[4-(4-fluorophenoxy)phenoxy]propyl]amino]propionic acid
8. 3-[methyl[3-[4-(4-biphenyloxy)phenoxy]propyl]amino]propionic acid
9. N-[3-[[3-[4-(phenylmethyl)phenoxy]propyl]methylamino]propionyl]benzenesulfonamide
10. 1-[2-[4-(phenylmethyl)phenoxy]ethyl]-2-methyl-4-(1H-tetrazol-5-yl)piperidine
11. 1-[2-[4-(phenylmethyl)phenoxy]ethyl]-4-(1H-tetrazol-5-yl)piperidine In some embodiments, compositions of the invention comprise a statin, and methods of the invention comprise administration of a statin. In this context, the term "statin" should be understood to refer to any of the class of inhibitors of 3-hydroxy-3-methylglutarlcoenzyme A (HMG-CoA) reductase, the enzyme that converts HMG-CoA to the cholesterol precursor mevalonic acid. Numerous compounds with high specificity for this enzyme have been developed and approved for human therapy. Compositions of the invention may comprise a statin that is listed in Agent Table III herein, such as rovuvastatin (also known visastatin), fluvastatin, atorvastatin, lovastatin (also known as mevolin), simvastatin, pravastatin, pitavastatin, mevastatin, crevastatin, ML-236A, ML-236B, MBV-530A and MB-530B.

References to agents should be understood to include pharmaceutically acceptable salts, acids, bases, esters, pro-drugs, metabolites, and other common formulation variants of the agents.

An increasing body of emerging evidence identifies serum CRP as a marker for cardiovascular morbidity/mortality, and correlates reductions in serum CRP to better clinical outcomes. (See, e.g., U.S. Pat. No. 6,040,147, Ridker et al., N. Engl. J. Med. 352(1): 20-28 (2005); Nissen et al., N. Engl. J. Med. 352(1): 29-38 (2005); and Pearson et al., Circulation 107: 499-511 (2003).) Serum CRP in excess of 3.0 mg/L is considered high risk; from 1.0 to 3.0 average risk; and below 1 mg/L low risk. (Pearson et al.) Compositions and methods of the invention provide tools for reducing serum CRP. Reductions in CRP can be measured on a concentration basis, where compositions and methods that achieve CRP below 3.0 mg/L are preferred; with still more preferred targets of 2.75 mg/L, 2.5 mg/L, 2.25 mg/L, 2.0 mg/L, 1.75 mg/L, 1.5 mg/L, 1.25 mg/L, 1.0 mg/L, 0.75 mg/L, and 0.5 mg/L. Reductions in CRP also can be measured on a percentage basis, where clinical effectiveness is evaluated as a percentage reduction in CRP in a patient compared to no drug therapy or compared to single drug therapy. Depending on the initial CRP measurement, compositions and methods that reduce CRP anywhere from 10%-90% or more are contemplated, e.g., reductions of 10%, 20%, 25%, 30%, 40%, 50%, 60%, 65%, 70%, 75%, 80%, or any target in between these values. Reductions in CRP can also be measured relative to quartile or quintile distribution of CRP in the normal population (i.e., from $4^{th}$ quartile to $3^{rd}$ quartile or from $3^{rd}$ quartile to $2^{nd}$ quartile). For example, upper quartiles, having serum CRP greater than about 2.0 mg/L, defines a population to target for treatment according to the invention to reduce CRP an/or redule risk of MI or other adverse events.

The invention also includes methods of reducing MPO and method of monitoring MPO levels. Reductions in MPO can be measured on a concentration basis, where compositions and methods that reduce MPO level relative to the quartile distribution of MPO in the normal population (i.e., from $_4$th quartile to $3^{rd}$ or from $3^{rd}$ to $2^{nd}$) are preferred. Reductions in MPO also can be measured on a percentage basis, where clinical effectiveness is evaluated as a percentage reduction in MPO in a patient compared to no drug therapy or compared to single drug therapy. Depending on the initial MPO measurement, compositions and methods that reduce MPO anywhere from 10%-90% or more are contemplated, e.g., reductions of 10%, 20%, 25%, 30%, 40%, 50%, 60%, 65%, 70%, 75%, 80%, or any target in between these values.

Soluble CD40 ligand (sCD40L) is a marker of inflammation as well as a marker for pro-thrombotic and pro-atherogenic processes. Elevated levels of sCD40L are associated with increased cardiovascular risk, including a heightened risk of death in patients with acute coronary syndromes (Varo et al. Circulation 108:1049-1052, 2003 and Schonbeck et al. Circ Res 89:1092-1103, 2001). Patients having an increased risk of ACS, such as MI, have levels of sCD40L that are greater than the 75th percentile, particularly patients in the 90-99th percentile are at a great risk. In addition, patients having an increased risk of ACS, including MI, have levels of sCD40L that are in the third or forth quartile.

The invention also contemplates methods of reducing serum sCD40L levels and method of monitoring serum sCD40L levels. Reductions in sCD40L can be measured on a concentration basis, where compositions and methods that reduce sCD40L levels relative to the quartile distribution of sCD40L in the normal population (i.e., from $4^{th}$ quartile to $3^{rd}$ or from $3^{rd}$ to $2^{nd}$) are preferred. Reductions in sCD40L also can be measured on a percentage basis, where clinical effectiveness is evaluated as a percentage reduction in sCD40L in a patient compared to no drug therapy or compared to single drug therapy. Depending on the initial sCD40L measurement, compositions and methods that reduce sCD40L anywhere from 10%-90% or more are contemplated, e.g., reductions of 10%, 20%, 25%, 30%, 40%, 50%, 60%, 65%, 70%, 75%, 80%, or any target in between these values. Adminsitration of leukotriene synthesis inhibitors, such as the molecules described herein, is specificially contemplated in amounts effective to achieve the desired reduction in sCD40 lignad. Repeated measurements to monitor and maintain the sCD40L reduction and adjust dosing is specifically contemplated.

In some variations of the invention, the composition of the invention includes the leukotriene synthesis inhibitor in an amount effective to reduce serum C-reactive protein (CRP) in a human subject. In some variations, the composition of the invention includes the statin in an amount effective to reduce serum low density lipoprotein cholesterol (LDL) and reduce serum CRP in a human subject. In at least one preliminary and short term study described herein, human subjects that already enjoyed the CRP-lowering benefits of statin therapy were administered the LT inhibitor BAY-X1005, and significant further reductions in CRP were detected. Combination therapy of a longer duration may result in further CRP reduction than the 20-30% effect observed in the short term study.

In an embodiment of the invention, the compositions comprise a leukotriene synthesis inhibitor in an amount effective to reduce serum CRP in a human subject and a statin. In another embodiment, the compositions comprise a statin in an amount effective to reduce serum LDL-C in a human subject and a leukotriene synthesis inhibitor. The invention also encompasses compositions comprising a leukotriene synthesis inhbitor and a statin in amounts effective to synergistically reduce CRP in a human subject.

In one variation, the leukotriene inhibitor and the statin are included in the composition of the invention in amounts effective to synergistically reduce serum C-reactive protein in a human subject.

For practice of the invention with BAY-X1005, doses of 50-750 mg per day for adult human patients are contemplated. Doses of 100-500 mg, from one to five times per day, is contemplated. Doses of 250-375 mg, from one to three times per day, is preferred.

Dosing for clinically approved statins have been developed and published by the manufacturers. In a preferred embodiment, the statin is co-formulated with the LT inhibitor in a pill or capsule for administrations 1-4 times per day.

The invention provides for methods of using these compositions to reduce risk factors for cardiovascular diseases such as for MI, ACS, stroke, or PAOD. In one method, a composition comprising a leukotriene synthesis inhibitor and a statin is administered to a human subject exhibiting one or more risk factors for MI, ACS, stroke or PAOD, wherein the composition is administered in an amount effective to reduce at least one risk factor for MI, ACS, stroke or PAOD. Preferably, the risk factor is elevated serum LDL-C or an elevated inflammatory marker such as CRP or serum amyloid A. In a highly preferred embodiment, LDL-C and CRP are both reduced clinically significant amounts, where a clinically significant amount is an amount that correlates with a statistically significant measurable reduction in risk for an adverse cardiovascular event, when analyzed in a population, e.g., in a clinical study.

The invention also provides for method of using these compounds to reduce CRP in human subject. In one variation, the invention is a method of reducing C reactive protein (CRP) in a human subject, comprising administering to a human in need of treatment to reduce CRP a composition of the invention containing the LT inhibitor and the statin as described above, in an amount effective to reduce serum C reactive protein in the human subject. The identification of a human in need of treatment for CRP reduction can be based on a variety of factors described herein, including genetic factors, CRP measurements, measurements of other inflammatory markers, and measurements of non-genetic and non-inflammatory markers for risk of MI. In one variation, the method includes selecting for the administering step a human subject at risk for a disease or condition selected from the group consisting of myocardial infarction, acute coronary syndrome, stroke, or peripheral arterial occlusive disease. Thus, the invention provides a method that comprises selecting a human subject at risk for MI, ACS, stroke or PAOD and administering to the subject a composition comprising a leukotriene synthesis inhibitor and a statin wherein the composition is in an amount effective to reduce serum CRP in a human subject. The method may further comprise the step of measuring serum CRP in the human subject to monitor therapeutic efficacy of the composition, wherein a decrease in serum CRP following the administering of the composition indicates therapeutic efficacy.

In still another variation, the monitoring of risk factors and/or toxicity is used to adjust dose or dosing. For example, dose or dosing of a statin or a leukotriene synthesis inhibitor is increased if serum CRP and/or LDL and/or serum or urinary leukotriene measurements do not decrease to a target level, such as a level equivalent to the bottom 50 percentile, 40 percentile, 30 percentile, 20 percentile, 10 percentile, 1 percentile of a population, or other target percentile in between these exemplary targets. As described above, monitoring also can be used to adjust dosing to achieve a target level of serum CRP, or to achieve a target percentage reduction in CRP for a particular human subject.

The monitoring may involve parameters in addition to CRP. A benefit of the statin for many human subjects will be the reduction in serum LDL, and methods of the invention include administering the composition of the invention in an amount effective to reduce serum LDL and serum leukotrienes in the human subject. In this embodiment, serum LDL may be monitored. Other markers described herein, including serum amyloid A nad myeloperoxidase, may be monitored.

In certain embodiments of the invention, the individual or human subject selected for treatment is an individual who has at least one risk factor, such as an at-risk haplotype for myocardial infarction, stroke or PAOD; an at-risk haplotype in the FLAP gene; a polymorphism in a FLAP nucleic acid; an at-risk polymorphism in the 5-LO gene promoter. The invention provides for methods of selecting a human subject susceptible to MI comprising determining a FLAP genotype or haplotype of a human subject, and selecting for treatment a human subject with a FLAP genotype or haplotype that correlates with an increased risk of MI. The methods of the invention include selecting a human subject with the presence of at least one at-risk haplotype within or near the FLAP gene such as a haplotype shown in Table 14; a haplotype shown in Table 15; a haplotype shown in Table 21; haplotype B4; haplotype B5; haplotype B6; haplotype A4; haplotype A5; haplotype HapB, haplotype HapC1, haplotype HapC2, haplotype HapC3, haplotype HapC4-A and haplotype HapC4-B.

The methods of the invention also include selecting a human subject for treatment, wherein the presence in said subject of a haplotype comprising marker SG13S106 (SNP DG00AAHII) (SEQ ID NO: 1, position 176579), allele G, identifies the subject as having a susceptibility to MI; the presence of a haplotype comprised of markers SG13S99 (DG00AAFIU), allele T (SEQ ID NO: 1, position 138551); SG13S377 (DG00AAJFF) (SEQ ID NO: 1, position 169965), allele G; SG13S106 [SNP DG00AAHII] (SEQ ID NO: 1, position 176579), allele G; SG13S32 (SEQ ID NO: 1, position 198547), allele A; and SG13S35 (SEQ ID NO: 1, position 206117), allele G identifies the subject as having a susceptibility to MI; the presence in said subject of a haplotype comprised of markers: SG13S375 (SEQ ID NO: 1, position 164874), allele T; SG13S25 (SEQ ID NO: 1, position 165553), allele G; SG13S32 (SEQ ID NO: 1, position 176579), allele A; and SG13S106 (SEQ ID NO: 1, position 198547), allele G or A identifies the subject as having a susceptibility to MI, the presence in said subject of a haplotype comprised of marker SG13S375(SNP DG00AAJFC) (SEQ ID NO: 1, position 164874), allele T; and SG13S25 (SEQ ID NO: 1, position 165553), allele G, identified the subject as having a susceptibility to MI; the presence in said subject of a haplotype comprised of marker SG13S375(SNP DG00AAJFC) (SEQ ID NO: 1, position 164874), allele T; and SG13S25 (SEQ ID NO: 1, position 165553), allele G, and SG13S32 (SEQ ID NO: 1, position 198547) identified the subject as having a susceptibility to MI, the presence in said subject of a haplotype comprised of marker SG13S106 (SNP DG00AAHII) (SEQ ID NO: 1, position 176579), allele G, SG13S30 (SEQ ID NO: 1, position 193840), allele G; and SG13S42 (SEQ ID NO: 1, position 203877), allele A, identifies the subject as having a susceptibility to MI, the presence in said subject of a haplotype comprised of markers: SG13S377 (SEQ ID NO: 1, position 169965), allele A; SG13S114 (SEQ ID NO: 1, position 178096), allele A; SG13S41 (SEQ ID NO: 1, position 202045), allele A; and SG13S35 (SEQ ID NO: 1, position 206117), allele G, identifies the subject as having a susceptibility to MI.

In another embodiment, the invention provides for a method of selecting a human subject susceptible to MI comprising analyzing nucleic acid of a human subject for the presenece or absence of at least one FLAP polymorphism that correlates with a susceptibility to MI. FLAP polymorphisms that that correlate to susceptibility to MI include SG13S377 (SEQ ID NO: 1, position 169965), allele A; SG13S114 (SEQ ID NO: 1, position 178096), allele A; SG13S41 (SEQ ID NO: 1, position 202045), allele A; and SG13S35 (SEQ ID NO: 1, position 206117), allele G. Additional FLAP polymorphisms that that correlate to a susceptibility to MI include SG13S375 (SEQ ID NO: 1, position 164874), allele T, SG13S25 (SEQ ID NO: 1, position 165553), allele G; SG13S32 (SEQ ID NO: 1, position 176579), allele A; and SG13S106 (SEQ ID NO: 1, position 198547), allele G or A. The methods may further comprise selecting a subject with the presence of at least one FLAP polymorphism and with the presence of elevated CRP, sCD40L or MPO.

An another embodiment, the invention provides for methods of prophylaxis therapy for myocardial infarction (MI) comprising analyzing nucleic acid of a human subject for the presence and absence of a FLAP haplotype, wherein the haplotype is comprised of markers: SG13S377 (SEQ ID NO: 1, position 169965), allele A; SG13S114 (SEQ ID NO: 1, position 178096), allele A; SG13S41 (SEQ ID NO: 1, position 202045), allele A; and SG13S35 (SEQ ID NO: 1, position 206117), allele G, and selecting for treatment a human subject having nucleic acid with the presence of the FLAP haplotype. This method further comprises administering to the subject a composition comprising a therapeutically effective amount of an MI therapeutic agent that inhibits leukotriene synthesis in vivo, wherein the MI therapeutic agent inhibits leukotriene synthesis by inhibiting the activity of at least one protein selected from 5-Lipoxygenase activating protein (FLAP) and 5-lipoxygenase (5-LO).

In one embodiment, the invention provides for methods of decreasing risk of a subsequent myocardial infarction in an individual who has had at least one myocardial infarction, comprising administering a therapeutically effective amount of an MI therapeutic agent to the individual, wherein the MI therapeutic agent inhibits leukotriene synthesis by inhibiting the activity of at least one protein selected from 5-Lipoxygenase activating protein (FLAP) and 5-lipoxygenase (5-LO) and monitoring myeloperoxidase (MPO) in the individual before and during administration of the therapeutic agent, wherein the therapeutic agent is administered in an amount effective to reduce the leukotriene level in a subject.

In another embodiment, the invention provides for methods of screening a human subject for susceptibility for MI comprising analyzing nucleic acid of a human subject for the presence and absence of the FLAP haplotype comprised of markers: SG13S377 (SEQ ID NO: 1, position 169965), allele A; SG13S114 (SEQ ID NO: 1, position 178096), allele A; SG13S41 (SEQ ID NO: 1, position 202045), allele A; and SG13S35 (SEQ ID NO: 1, position 206117), allele G, and identifying the subject as having a susceptibility to MI, wherein the presence of the FLAP haplotype correlates with an increased risk of MI.

In another embodiment, the invention provides methods of screening a human subject for susceptibility to MI comprising analyzing nucleic acid of a human subject for the presence or absence of the LTA4H haplotype comprised of markers: DG12S1664, SG12S16, SG12S17, SG12S18, SG12S21, SG12S22, SG12S23, SG12S24, SG12S25, SG12S26, DG12S1666, SG12S100, SG12S28, and SG12S144, with alleles 0, C, A, T, G, G, T, T, A, T, 0, and T, T, and A, respectively. The allelic frequency of a shorter version of this haplotype including markers DG12S 1664, SG12S26, DG12S1666, and SG12S144, with alleles 0, T, 0, and A, respectively, is 51% in male MI patients and 43% in controls (carried by 76% of male patients and 67% of controls). Allelic frequency of this haplotype is higher, or 56%, in a subgroup of patients that have had more than one MI.

Table 42 shows the results of the haplotype association analysis using 1560 unrelated MI patients and 953 unrelated population controls. A haplotype comprised of the consecutive markers was highly significant in MI patients that had also had either stroke or peripheral arterial occlusive disease (PAOD) (P-value adjusted for multiple comparisons=0.007). The fact that the haplotypes shown in Table 42 are more significant in MI patients that have more than one clinically evident cardiovascular complication might indicate that the gene played a role in clinical activity or severity of the atherosclerotic disease. The significantly associated haplotype is comprised of the following consecutive markers; SG12S438, DG12S1664, SG12S16, SG12S21, SG12S23, SG12S25, SG12S26, DG12S1666, SG12S100, SG12S28, SG12S143, SG12S144, SG12S221, SG12S222, SG12S223, SG12S225, SG12S226, SG12S233, SG12S237, and DG12S1668 with alleles C, 0, C, G, T, A, T, 0, T, T, T, A, G, C, C, G, G, C, T, and 0.

Particular LTA4H haplotypes, HapK, HapL and HapQ, are set out in Table 47. The invention includes methods of screening a human subject for susceptibility to MI comprising analyzing nucleic acid of a human subject for the presence or absence of the HapK haplotype comprised of the following markers: SG12S16, SG12S21, SG12S23, SG12S25, SG12S26, SG12S100, SG12S28, SG12S143, SG12S144, SG12S221 with alleles C, G, T, A, T, T, T, C, G and G, respectively. The invention also provides methods of screening a human subject for susceptibility to MI comprising analyzing nucleic acid of a human subject for the presence or absence of the HapL haplotype comprised of the following markers: SG12S16, SG12S21, SG12S23, SG12S25, SG12S26, SG12S100, SG12S28, SG12S143, SG12S144, SG12S221 with alleles C, G, T, A, T, T, T, T, A and G, respectively. The invention also provides methods of screening a human subject for susceptibility to MI comprising analyzing nucleic acid of a human subject for the presence or absence of the HapQ haplotype comprised of the following markers SG12S16, SG12S21, SG12S23, SG12S25, SG12S26, SG12S100, SG12S28, SG12S143, SG12S144, SG12S221 with alleles C, G, T, G, T, C, T, T, A and G, respectively.

As described herein, smaller subsets of markers, or even single individual markers, may be used as a surrogate for screening for a predictive haplotype because the subsets/markers with predictive values include marker SG12S551 having allele T or SG12S540 having allele A or marker rs250477 having allele C and marker rs2660896 having allele T or marker SG12S540 (re2540500) having allele A and marker rs107353540 having allele A.

For example, the invention provides for methods of assessing a susceptibility to myocardial infarction (MI) or acute coronary syndrome (ACS) in a human individual, comprising screening nucleic acid of the individual for at least one polymorphism in a LTA4H nucleic acid that correlates with increased occurrence of myocardial infarction or ACS in a human population, wherein the presence of the at least one polymorphism identifies the individual as having elevated susceptibility to MI or ACS, and wherein the absence of the at least one polymorphism in the nucleic acid identifies the individual as not having the elevated susceptibility. Such polymorphisms include allele T at marker SG12S551 or allele A at marker SG12S540 or allele C at marker rs250477 and allele T at marker rs2660896 or allele A at marker SG12S540 (re2540500) and allele A at marker rs107353540

The study described in Example 21 demonstrates that the frequency of the LTA4H haplotype, HapK, is rare in black African American subjects but confers a surprisingly great relative risk for MI. The invention also provides for methods of prophylaxis therapy for myocardial infarction (MI) in a human comprising selecting a human subject having a race that includes black African ancestry, and administering to the subject a composition comprising a therapeutically effective amount of an MI therapeutic agent that inhibits leukotriene synthesis in vivo.

Human subjects having a race that includes black African ancestry may be persons of African descent or lineage. Black African ancestry may be determined by self reporting as African-Americans, Afro-Americans, Black Americans, being a member of the black race or being a member of the negro race. For example, African Americans or Black Americans are those persons living in North America and having origins in any of the black racial groups of Africa. For example, self-reported persons of black African ancestry may have at least one parent of black African ancestry or at least one grandparent of black African ancestry.

Human subjects having a race that includes black African ancestry may also be determined by genetic analysis. Genetic analysis of ancestry may be carried out using unlinked microsatellite markers such as those set out in Smith et al. *Am J Hum Genet* 74, 1001-13 (2004). Particularly, African ancestry may be determined using the unlinked microsatellite markers set out in Table 54 herein and described in Example 21. A person's alleles for each tested marker are identified and using standard computational techniques, compared to the allelic frequencies of each marker in different races. The use of increasing numbers of these markers generally provides an increasing arsenal of information to assess probable racial origin/mixture. For example, the selecting of human subjects of black African ancestry comprises analyzing nucleic acid from the human subject to determine a racial genotype comprised of at least 8 microsatellite markers set forth in Table 54, and selecting for therapy a subject with a genotype that correlates with the race. Preferably, the racial genotype is comprised of alleles of the markers D1S466, D3S1583, D3S4011, D4S3014, D6S1037, D9S1777, D20S113 and D22S1172, that correlate with African and European ancestry.

In some variations of the invention, the methods comprise selecting a human subject having both a race that includes black African ancestry and at least one additional genetic, family or medical history risk factor of cardiovascular disease. In some variations, the additional family or medical history risk factor may be a race that includes European ancestry, whereby the subject has mixed African and European ancestry. An exemplary subject having a race including a mixed African and European ancestry may have at least one parent or grandparent of African ancestry and at least one parent or grandparent of European ancestry. European ancestry may be determined by self reporting as European ancestor(s) (from a country in Europe), European American, white or Caucasian. European ancestry may also be determined by genetic analysis using unlinked microsatellite markers as described in Example 21 and set out in Table 54.

In some variations, the additional risk factor comprises a genetic variation that correlates with susceptibility to MI, in at least one gene selected from 5-lipoxygenase activating protein (FLAP) and leukotriene A4 hydrolase (LTA4H). In some variations of the method, the selecting step comprises determining a FLAP genotype or haplotype of a human subject, and selecting for therapy a human subject with the race and with a FLAP genotype that correlates with susceptibility to MI. In particular, the FLAP genotype or haplotype that correlates with susceptibity of MI is HapA or HapB or the haplotypes provided in Table 5, Table 7 and Table 34.

In other variations of the method, the selecting step comprises determining a LTA4H genotype or haplotype of a human subject, and selecting for therapy a human subject with the race and with a LTA4H genotype that correlates with susceptibility to MI. In particular, the LTA4H genotype or haplotype that correlates with susceptibility to MI is HapK, HapL or HapQ or the haplotypes provided in Table 47 or 51. The selected human subject may be determined to have a LTA4H haplotype comprising markers SG12S25 having allele A, SG12S26 having allele T, SG12S143 having allele C, SG12S144 having allele G and SG12S221 having allele G. The selected human subject may also be determined to have a LTA4H haplotype comprising markers SG12S25 having allele A, SG12S26 having allele T, SG12S100 having allele T, SG12S28 having allele T, SG12S143 having allele C, SG12S144 having allele G and SG12S221 having allele G. In addition, selected human subject may also be determined to have a LTA4H haplotype comprising markers SG12S16 having allele C, SG12S21 having allele G, SG12S23 having allele T, SG12S25 having allele A, SG12S26 having allele T, SG12S100 having allele T, SG12S28 having allele T, SG12S143 having allele C, SG12S144 having allele G and SG12S221 having allele G.

A surrogate haplotype is a haplotype that correlates with the original haplotype, but may be defined by different markers. A perfect surrogate haplotype is one that will identify exactly the same individuals as the original haplotype. For example, all subjects that carry the original haplotype will also carry the the surrogate haplotype and all that carry the surrogate also carry the original haplotype. A perfect surrogate will have a correlation coefficient ($R^2$) of 1. Surrogate haplotypes may not be perfect, for example if the frequency of the surrogate is different than that of original haplotype then it is likely that all subjects that carry the original haplotype will also carry the surrogate haplotype but not all that carry the surrogate will carry the original (if the surrogate is more frequent than the original haplotype). In this case the $R^2$ is less than 1.

In some variations of the invention, the selected human subject may be determined to have a HapK surrogate haplotype. For example, the selected human subject may be determined to have a LTA4H genotype comprising marker SG12S551 having allele T, or SG12S540 having allele A. The SG12S551 may serve as a single SNP surrogate for HapK, since its T allele correlates to HapK in HapMap CEU samples (The International HapMap Project. *Nature* 426, 789-96 (2003)) with $R^2=0.74$, D'=1. The SG12S540 may also serve as a single SNP surrogate for HapK, since its A allele correleates to HapK in HapMap CEU samples with $R^2=0.81$ and D'=1.

In another variation of the invention, the selected human subject may be determined to have the HapK surrogate haplotype comprising marker rs250477 having allele C and marker rs2660896 having allele T. The correlation of this 2 SNP surrogate haplotype to HapK is $R^2=0.95$ for both African American patients and Caucasian patients. In addition, the selected human subject may be determined to have the HapK surrogate haplotype comprising marker SG12S540 (re2540500) having allele A and marker rs107353540 having allele A. The correlation of this 2 SNP haplotype to HapK is $R^2=0.95$ for both African American patients and Caucasian patients.

In some variations of the method, the selecting of human subjects comprises analyzing nucleic acid of a human subject for the presence or absence of at least one FLAP polymorphism or LTA4H polymorphism that correlates with a susceptibility to myocardial infarction, and selecting for therapy a human subject with the race and with the at least one polymorphism that correlates with susceptibility to MI. The FLAP polymorphic markers that correlate with MI include those SNPs set out in Table 5, Table 7 and Table 34 and those SNPs within the HapA or HapB FLAP haplotype. The LTA4H polymorphic markers that correlate with MI include those SNPs set out in Table 47 or 51 and those SNPs within the HapK, HapL and HapQ LTA4H haplotype.

The individuals or human subjects selected for treatment in any of the methods of the invention may have at least one family or medical history risk factor such as diabetes; hypertension; hypercholesterolemia; elevated triglycerides; elevated lp(a); obesity; ankle/brachial index (ABI) less than 0.9; a past or current smoker; transient ischemic attack; transient monocular blindness; carotid endarterectomy; asymptomatic carotid stenosis; claudicatioin; limb ischemia leading to gangrene, ulceration or amputation; a vascular or peripheral artery revascularization graft; increased serum LDL cholesterol and/or decreased HDL cholesterol; serum total cholesterol >200 mg/dl, increased leukotriene synthesis; and/or at least one previous myocardial infarction, ACS, stable angina, previous transient ischemic attack, transient monocular blindness, or stroke, asymptomatic carotid stenosis or carotid endarterectomy, atherosclerosis, requires treatment for restoration of coronary artery blood flow (e.g., angioplasty, stent, revascularization procedure).

In addition, the individuals or human subjects selected for treatment in any of the methods of the invention may have an elevated inflammatory marker, e.g., a marker such as an end product of the leukotriene pathway, such as LTB4, C-reactive protein (CRP), serum sCD40L, serum amyloid A, fibrinogen, a leukotriene, a leukotriene metabolite, interleukin-6, tissue necrosis factor-alpha, a soluble vascular cell adhesion molecule (sVCAM), a soluble intervascular adhesion molecule (sICAM), E-selectin, matrix metalloprotease type-1, matrix metalloprotease type-2, matrix metalloprotease type-3, matrix metalloprotease type-9, myeloperoxidase (MPO), and N-tyrosine). The invention provides for methods of prophylaxis therapy for MI comprising administering a MI therapeutic agent in an amount effective to reduce the elevated serum level of at least one elevated inflammatory markers.

In a particular embodiment, individuals or human subjects selected for treatment in any of the methods of the invention have an elevated CRP level in excess of 3.0 mg/L, In addition, the invention contemplates selecting human subjects for treatment that have greater than 2.75 mg/L, greater than 2.5 mg/L or greater than 2.25 mg/L, greater than 2.0 mg/L. The invention also contemplates selecting human subjects for treatment that have a median CRP level, e.g. CRP level greater than 1.75mg/L or greater than 1.5 mg/L.

In some variations of the invention, individuals or human subjects selected for treatment in any of the methods of the invention have an elevated serum sCD40L level in excess of 1.4 ng/ml. In addition, the invention contemplates selecting human subjects for treatment that have greater than 1.5 ng/ml, greater than 2.0 ng/ml, greater than 2.5 ng/ml, greater than 3.0 ng/ml, greater than 3.5 ng/ml, greater than 4.0 ng/ml, greater than 4.5 ng/ml or greater than 5.0 ng/ml.

In a particular embodiment, the invention provides for methods of prophylaxis for myocardial infarction (MI) comprising administering to a subject in need of prophylaxis for myocardial infraction a composition comprising a therapeutically effective amount of an MI therapeutic agent that inhibits leukotriene synthesis in vivo, and monitoring myeloperoxidase (MPO) level in the human subject before and during the prophylaxis treatment, wherein the MI therapeutic agent is administered in an amount effective to reduce the MPO level in a subject.

In another embodiment, the invention provides for methods of prophylaxis for myocardial infarction (MI) comprising administering to a subject in need of prophylaxis for myocardial infraction a composition comprising a therapeutically effective amount of an MI therapeutic agent that inhibits leukotriene synthesis in vivo, and monitoring soluble CD40 ligand (CD40L) level in the serum of the human subject before and during the prophylaxis treatment, wherein the MI therapeutic agent is administered in an amount effective to reduce the sCD40L level in a subject.

The invention also provides for methods of screening a human subject for risk of developing myocardial infarction, comprising contacting a blood sample from the human subject with a calcium ionophore to stimulate production of a leukotriene; and measuring production of a leukotriene in the blood sample after the contacting step, wherein elevated leukotriene production compared to a control correlates with increased risk of developing myocardial infarction (MI). The control in these methods may be a human of the same sex as the subject selected for treatment or may be a human age matched to the subject selected for treatment.

Human subjects that already are treated with statins can enjoy the benefit of the present invention if the subjects therapy is modified to include an LT antagonist. Thus, in still another embodiment, the invention is a method of reducing C reactive protein (CRP) in a human subject, comprising: selecting a human subject that receives statin therapy to reduce serum LDL, wherein the statin therapy optionally reduces serum CRP in the human subject; and administering to the human subject a leukotriene synthesis antagonist, in an amount effective to further reduce CRP in the human subject.

In still another embodiment, the invention is a method of reducing C reactive protein (CRP) in a human subject, comprising: identifying a human subject in need of treatment to reduce serum CRP; administering to the human subject a composition comprising a statin; and administering to the human subject a composition comprising a leukotriene synthesis inhibitor, wherein the statin and the leukotrience synthesis inhibitor are administered in amounts effective to reduce serum CRP in the human subject. The statin and the LT inhibitor can be simultaneously administered as a single composition, as described above; can be simultaneously administered as separate compositions; or can be sequentially administered. Depending on the dosing schedule, the daily administration regimen may include simultaneous administration at some times and separate administration at other times, e.g., if one agent is administered twice daily and another three times daily.

In certain embodiments of the invention, the individual or human subject selected for treatment using any of the preceding methods of the invention is an individual who has at least one risk factor, such as an at-risk haplotype for myocardial infarction, stroke or PAOD; an at-risk haplotype in the FLAP gene; a polymorphism in a FLAP nucleic acid; an at-risk polymorphism in the 5-LO gene promoter, diabetes; hypertension; hypercholesterolemia; elevated triglycerides; elevated lp(a); obesity; ankle/brachial index (ABI) less than 0.9; a past or current smoker; transient ischemic attack; transient monocular blindness; carotid endarterectomy; asymptomatic carotid stenosis; claudicatioin; limb ischemia leading to gangrene, ulceration or amputation; a vascular or peripheral artery revascularization graft; an elevated inflammatory marker (e.g., a marker such as C-reactive protein (CRP), serum sCD40, serum amyloid A, fibrinogen, a leukotriene, a leukotriene metabolite, interleukin-6, tissue necrosis factor-alpha, a soluble vascular cell adhesion molecule (sVCAM), a soluble intervascular adhesion molecule (sICAM), E-selectin, matrix metalloprotease type-1, matrix metalloprotease type-2, matrix metalloprotease type-3, matrix metalloprotease type-9, myeloperoxidase (MPO), and N-tyrosine); increased LDL cholesterol and/or decreased HDL cholesterol; increased leukotriene synthesis; and/or at least one previous myocardial infarction, ACS, stable angina, previous transient ischemic attack, transient monocular blindness, or stroke, asymptomatic carotid stenosis or carotid endarterectomy, atherosclerosis, requires treatment for restoration of coronary artery blood flow (e.g., angioplasty, stent, revascularization procedure).

The invention additionally pertains to methods of assessing an individual for an increased risk of MI, ACS, atherosclerosis, stroke, or PAOD, by assessing or monitoring a level of a leukotriene metabolite (e.g., LTE4, LTD4, LTB4) in the individual (e.g., in a sample of blood, serum, plasma or urine). An individual or human subject selected for treatment may have an elevated measurement of a leukotriene or leukotriene metabolite, such as LTC4, LTD4, LTB4 and LTE4. The level of leukotrienes and leukotriene metabolites may be measured in serum, plasma, blood or urine in the individual. An increased level of leukotriene metabolite is indicative of an increased risk. The invention also encompasses methods of assessing an individual for an increased risk of MI, ACS, atherosclerosis, stroke, transient ischemic attack, transient monocular blindness, asymptomatic carotid stenosis, PAOD, claudication, or limb ischemia, by stimulating production of a leukotriene or a leukotriene metabolite in a test sample from the individual (e.g., a sample comprising neutrophils), using a calcium ionophore, and comparing the level of the leukotriene or leukotriene metabolite with a control level. A level of production of the leukotriene or leukotriene metabolite that is significantly greater than the control level, is indicative of increased risk.

The invention further pertains to methods of assessing response to treatment with a leukotriene synthesis inhibitor, by assessing or monitoring a level of a leukotriene or leukotriene metabolite in the individual before treatment, and comparing the level to a level of the leukotriene or leukotriene metabolite assessed during or after treatment. A level that is significantly lower during or after treatment, than before treatment, is indicative of efficacy of the treatment with the leukotriene synthesis inhibitor. The level of leukotriene may be monitored in serum, plasma, blood or urine collected from the subject before, during and after treatment. The invention additionally pertains to methods of assessing response to treatment with a leukotriene synthesis inhibitor, by stimulating production of a leukotriene or a leukotriene metabolite in a first test sample from the individual (e.g., a sample comprising neutrophils) before treatment, using a calcium ionophore, and comparing the level of the leukotriene or leukotriene metabolite with a level of production of the leukotriene or leukotriene in a second test sample from the individual, during or after treatment. A level of production of the leukotriene or leukotriene metabolite in the second test sample that is significantly lower than the level in the first test sample, is indicative of efficacy of the treatment, for example, the treatment or therapeutic agent reduces the leukotriene level in the subject to the medial level of leukotrienes in human subjects in the general population or lower than that medial level.

Similarly, the invention encompasses methods of assessing response to treatment with a leukotriene synthesis inhibitor, by assessing or monitoring a level of an inflammatory marker in the individual before treatment, and during or after treatment. A level of the inflammatory marker during or after treatment, that is significantly lower than the level of inflammatory marker before treatment, is indicative of efficacy of the treatment.

To determine the effectiveness of compositions of the present invention comprising a statin, total cholesterol, LDL-C and/or triglycerides may be assessed from measurements of risk factor markers in the serum of a human subject administered the composition. A level of serum total cholesterol, LDL-C and/or triglycerides during or after treatment, that is significantly lower than the level of total cholesterol, LDL-C and/or triglycerides before treatment is indicative of the efficacy of the treatment.

The invention also pertains to use of leukotriene synthesis inhibitors for the manufacture of a medicament for the treatment of MI, ACS, stroke, PAOD, and/or atherosclerosis, as described herein, as well as for the manufacture of a medicament for the reduction of leukotriene synthesis.

In jurisdictions that forbid the patenting of methods that are practiced on the human body, the following restrictions are intended: (1) the selecting of a human subject shall be construed to be restricted to selecting based on testing of a biological sample that has previously been removed from a human body and/or based on information obtained from a medical history, patient interview, or other activity that is not practiced on the human body; and (2) the administering of a composition to a human subject shall be restricted to prescribing a controlled substance that a human subject will self-administer by any technique (e.g., orally, inhalation, topical application, injection, insertion, etc.). The broadest reasonable interpretation that is consistent with laws or regulations defining patentable subject matter is intended. In jurisdictions that do not forbid the patenting of methods that are practiced on the human body, the selecting of subjects and the administering of compositions includes both methods practiced on the human body and also the foregoing activities.

The invention further provides for methods of diagnosising susceptibility to myocardial infarction in a human subject comprising: screening for black African ancestry in the human subject, and screening for an LTA4H genotype or haplotype in a nucleic acid of the human subject, wherein the presence of the a black African ancestry and the genotype or haplotype in the nucleic acid is indicative of a susceptibility to cardiovascular disease. The screening for black African ancestry may be determined by any of the techniques described herein, such as patient self-reporting African ancestry or identification of African ancestry by genetic testing. Likewise, the at-risk haplotype is determined by any technique described herein, and is any at-risk haplotype described herein such as a HapK genotype or haplotype.

In an embodiment of the invention, the method of diagnosing comprises screening for a LTA4H haplotype comprising markers SG12S25 having allele A, SG12S26 having allele T, SG12S143 having allele C, SG12S144 having allele G and SG12S221 having allele G. The LTA4H haplotype screened for may also comprise markers SG12S25 having allele A, SG12S26 having allele T, SG12S100 having allele T, SG12S28 having allele T, SG12S143 having allele C, SG12S144 having allele G and SG12S221 having allele G. Further, the LTA4H haplotype screened for may comprise markers SG12S16 having allele C, SG12S21 having allele G, SG12S23 having allele T, SG12S25 having allele A, SG12S26 having allele T, SG12S100 having allele T, SG12S28 having allele T, SG12S143 having allele C, SG12S144 having allele G and SG12S221 having allele G.

A method of assessing a susceptibility to myocardial infarction (MI) or acute coronary syndrome (ACS) in a human individual, comprising screening nucleic acid of the individual for at least one polymorphism in a LTA4H nucleic acid that correlates with increased occurrence of myocardial infarction or ACS in a human population, wherein the presence of the at least one polymorphism identifies the individual as having elevated susceptibility to MI or ACS, and wherein the absence of the at least one polymorphism in the nucleic acid identifies the individual as not having the elevated susceptibility.

It is well established that different racial and ethnic groups show greater or lesser susceptibility to certain diseases and conditions, and there is at least one drug (BiDil™) that is FDA-approved for race-specific administration. A need exists for improved materials and methods for diagnosing racial or ethnic ancestry using genetic techniques. Genetic techniques offer a potential improvement over self-reporting, especially for individuals having unknown parents, such as adoptees, or for providing information about prior generations that are beyond an individual's known family tree. Another aspect of the invention is novel materials and methods for genetic assessment of race. For example, the invention includes a method of determining racial ancestry of a human individual, comprising assaying or analyzing nucleic acid of a human individual to determine a racial genotype comprised of one or more microsatellite marker(s) selected from the group consisting of D1S493, D1S2866, D1S2630, D1S466, D1S2847, D2S166, D6S405 D6S446, DG8S156, D8S1719, D8S1831, D8S1746, D9S1839, D9S1777, D10S1698, D11S4130, D11S1321 D11S4206, D11S1320, D12S1723, D13S152, D14S741, D16S404, D17S745, D17S1799, D18S464, D19S534, D19S113, D20S878, and D21S1884; wherein racial ancestry is determined from alleles of the one or more microsatellite markers, and determining racial ancestry based on the racial genotype. In some variations, in addition to these one or more markers, one assays one or more of the additional Table 54 markers to generate the racial genotype.

The invention also includes methods of assessing risk for a disease with race-dependent risks in a human individual comprising analyzing nucleic acid of a human individual to determine a racial genotype comprised of one or more microsatellite marker(s) selected from the group consisting of D1S493, D1S2866, D1S2630, D1S466, D1S2847, D2S166, D6S405 D6S446, DG8S156, D8S1719, D8S1831, D8S1746, D9S1839, D9S1777, D10S1698, D11S4130, D11S1321 D11S4206, D11S1320, D12S1723, D13S152, D14S741, D16S404, D17S745, D17S1799, D18S464, D19S534, D19S113, D20S878, and D21S1884; wherein racial ancestry is determined from alleles of the one or more microsatellite markers, determining racial ancestry based on the racial genotype and evaluating risk for the disease based on the racial genotype.

Studies with the ethnicity panel of markers described herein have shown that ethnicity is a quantifiable trait. The applications of such an ethnicity panel extends beyond its utility for determining degree of ancestry in the context of HapK and MI risk. Although a strong correspondence between self-reported ethnicity and genetically estimated ancestry has been found, self-report is not entirely reliable. Therefore, there are several scenarios where the ethnicity panel of markers described herein (using some or all of our markers beyond those previously reported) can be useful.

In one embodiment, the determination of racial or ethnic ancestry using the panel of genetic markers may assess susceptibility or risk for certain diseases. Many diseases have race-dependent incidences or risks. For example, hypertension is more common in African-Americans than in Caucasians. Traditionally, ethnicity or race is taken into account when defining a given individual's risk for a disease. However, that depends on self-reporting by the individual of his/her ethnicity. Using an ethnicity panel of markers may improve reliability of risk assessments for any given disease that shows race-dependent risks.

In another embodiment, the determination of racial or ethnic ancestry using the panel of genetic markers will allow for the matching of the genetic backgrounds of case and control groups in case-controlled clinical studies. In a traditional case-control association study with any protein, RNA, DNA or analyte marker it is valuable if the genetic backgrounds of the case and control groups be matched. Using an racial panel may improve reliability of matching case and control group beyond what can be achieved through self-reporting of race. This would have the benefit of decreasing chance of finding false-positive associations and would lead to more accurate determination of the magnitude of risk of markers that showed true association.

Difference in ethnic or racial ancestry may also be considered as a risk marker (genetic, RNA, protein, other analyte). Therefore, the determination of race or ancestry using the panel of genetic markers may be useful to condition that risk in any given subject based on his/her relative ethnic makeup. In addition, analysis of case-control studies based on an ethnicity panel may lead to discoveries that certain markers ((genetic, RNA, protein, other analyte) may show race-dependent risks. Use of an ethnicity panel may improve the sensitivity of finding ethnic differences in risk, especially when compared to self-reporting.

Additional features and variations of the invention will be apparent to those skilled in the art from the entirety of this application, including the drawing and detailed description, and all such features are intended as aspects of the invention. Likewise, features of the invention described herein can be re-combined into additional embodiments that also are intended as aspects of the invention, irrespective of whether the combination of features is specifically mentioned above as an aspect or embodiment of the invention. Also, only such limitations which are described herein as critical to the invention should be viewed as such; variations of the invention lacking limitations which have not been described herein as critical are intended as aspects of the invention.

In addition to the foregoing, the invention includes, as an additional aspect, all embodiments of the invention narrower in scope in any way than the variations specifically mentioned above. For example, although aspects of the invention may have been described by reference to a genus or a range of values for brevity, it should be understood that each member of the genus and each value within the range is intended as an aspect of the invention. Likewise, various aspects and features of the invention can be combined, creating additional aspects which are intended to be within the scope of the invention. Although the applicant(s) invented the full scope of the claims appended hereto, the claims appended hereto are not intended to encompass within their scope the prior art work of others. Therefore, in the event that statutory prior art within the scope of a claim is brought to the attention of the applicants by a Patent Office or other entity or individual, the applicant(s) reserve the right to exercise amendment rights under applicable patent laws to redefine the subject matter of such a claim to specifically exclude such statutory prior art or obvious variations of statutory prior art from the scope of such a claim. Variations of the invention defined by such amended claims also are intended as aspects of the invention.

BRIEF DESCRIPTION OF THE DRAWINGS

The foregoing and other objects, features and advantages of the invention will be apparent from the following more particular description of preferred embodiments of the invention.

FIG. 11, left panel, shows a pairwise LD between the 10 genotyped SNPs in a 48-kb region encompassing LTA4H. The markers are plotted equidistantly. Two measures of LD are shown: D' in the upper left triangle and $R^2$-values in the lower right triangle. Scales for both measures of LD are shown on the right. FIG. 11, right panel, depicts all haplotypes found in Icelandic population controls that have allelic frequency greater than 1%. The haplotype showing strongest association to MI in Iceland (HapK) is bold.

DETAILED DESCRIPTION OF THE INVENTION

Figure 1:
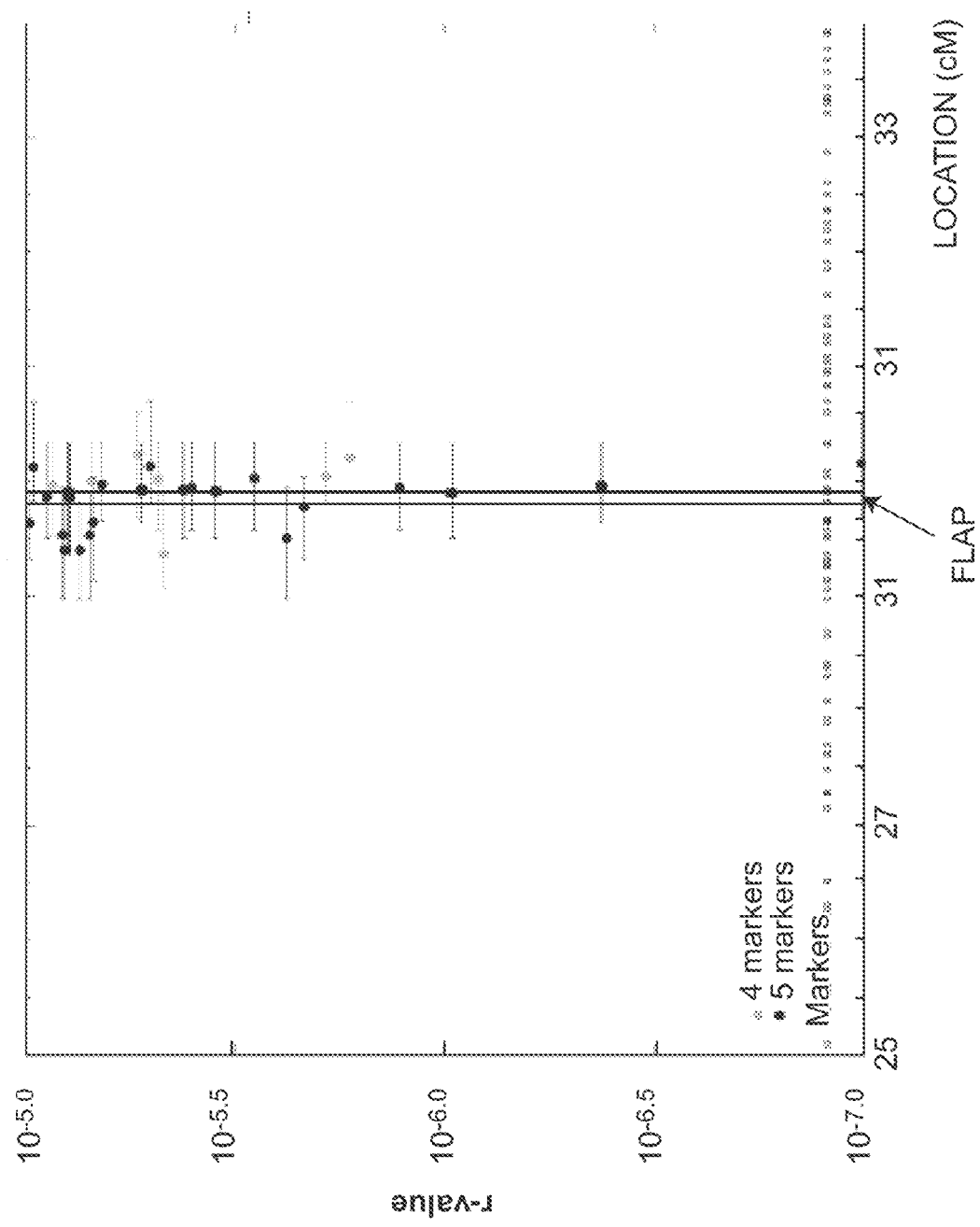
FIG. 1 shows the results from a haplotype association case-control analysis of 437 female MI patients versus 721 controls using combinations 4 and 5 microsatellite markers to define the test haplotypes. The p-value of the association is plotted on the y-axis and position of markers on the x-axis. Only haplotypes that show association with a p-value $<10^{-5}$ are shown in the figure. The most significant microsatellite marker haplotype association is found using markers DG13S1103, DG13S166, DG13S1287, DG13S1061 and DG13S301, with alleles 4, 0, 2, 14 and 3, respectively (p-value of $1.02\times10^{-7}$). Carrier frequency of the haplotype is 7.3% in female MI patients and 0.3% in controls. The segment that is common to all the haplotypes shown in the figure includes only one gene, FLAP.

Extensive genealogical information has been combined with powerful gene sharing methods to map a gene on chromosome 13q12-13 that is associated with myocardial infarction. A genome wide search for susceptibility genes for MI, using a framework map of 1000 microsatellite markers, revealed a locus suggestive of linkage on 13q12-13. Sixty families with 159 female MI patients that clustered within and including 6 meiotic events were used in linkage analysis. At first, only female MI patients were used in the linkage analysis in an effort to enrich for patients with stronger genetic factors contributing to their risk for MI. The epidemiological study of a population-based sample of Icelandic MI patients had previously suggested that the genetic factors for MI might be stronger for females than males, as the relative risk for siblings of female MI patients was significantly higher than the relative risk for siblings of male probands (1.59 (CI 1.47-1.73) vs. 1.35 (CI 1.28-1.42)) (unpublished data). The highest LOD score (2.5) was found at marker D13S289. The LOD score results for the families remained the same after adding 14 microsatellite markers to the candidate region. The inclusion of the additional markers increased the information on sharing by descent from 0.7 to 0.8, around the markers that gave the highest LOD scores. This linkage analysis mapped a gene contributing to MI to chromosome 13q12-13.

The candidate MI locus on chromosome 13q12-13 was then finely mapped with microsatellite markers. Patients with myocardial infarction and controls were initially genotyped with microsatellite markers with an average spacing between markers of less than 100 kb over the 12 Mb candidate region. Initial haplotype association analysis that included all genotyped microsatellite markers across the MI candidate locus, resulted in several extended haplotypes composed of 4 and 5 microsatellite markers that were significantly associated with female MI (see, e.g., Tables 14 and 15 below). A region common to all these extended haplotypes, is defined by markers DG13S166 and D13S1238. This region includes only one gene, the FLAP nucleic acid sequence. The two marker haplotype involving alleles 0 and −2 for markers DG13S166 and D13S1238, respectively, was found in excess in patients. Specific variants of the gene were then sought that were associated with MI.

In order to screen for SNPs in the FLAP gene, the whole gene was sequenced, both exons and introns. Initially, 9 SNPs identified within the gene were genotyped in patients and controls. Additional microsatellite markers close to or within the FLAP gene were also genotyped in all patients and controls. Five publicly known SNPs that are located within a 200 kb distance 5' to the FLAP gene were also genotyped in patients and controls. Haplotype association analysis in this case-control study including these additional markers showed several different variants of the same haplotype that were all significantly associated with female MI (see, e.g., Table 8). Table 9 shows two haplotypes that are representative of these female MI risk haplotypes which are referred to herein as the female MI "at risk" haplotypes. The relative risk for male MI patients that had the female MI-"at risk" haplotype was increased (see, e.g., Table 9), indicating that the female MI-"at risk" haplotype also increased the risk of having an MI in males. These results further strengthened the hypothesis that the FLAP gene was an MI susceptibility gene.

SNP Haplotype Association to MI, and Subsequently to Stroke and PAOD

In an effort to identify haplotypes involving only SNP markers that associate with MI, additional SNPs were identified by sequencing the FLAP gene and the region flanking the gene. Currently, a total of 45 SNPs in 1343 patients and 624 unrelated controls have been genotyped. Two correlated series of SNP haplotypes have been observed in excess in patients, denoted as A and B in Table 7. The length of the haplotypes varies between 33 and 69 kb, and the haplotypes cover one or two blocks of linkage disequilibrium. Both series of haplotypes (HapA and HapB) contain the common allele G of the SNP SG13S25. HapC2, identified in the analysis of the North American cohort (see Example 13), also contains the allele G of the SNP SG13S25. All haplotypes in the A series contain the SNP SG13S114, while all haplotypes in the B series contain the SNP SG13S106. In the B series, the haplotypes B4, B5, and B6 have a relative risk (RR) greater than 2 and with allelic frequencies above 10%. The haplotypes in the A series have slightly lower RR and lower p-values, but higher frequency (15-16%). The haplotypes in series B and A are strongly correlated, i.e., the haplotypes in B define a subset of the haplotypes in A. Hence, haplotypes in series B are more specific than A. However, haplotypes in series A are more sensitive, i.e., they capture more individuals with the putative mutation, as is observed in the population attributable risk which is less for B than for A. Furthermore, these haplotypes show similar risk ratios and allelic frequencies for early-onset patients (defined as onset of first MI before the age of 55) and for both genders. In addition, analyzing various groups of patients with known risk factors, such as hypertension, high cholesterol, smoking and diabetes, does not reveal any significant correlation with these haplotypes, suggesting that the haplotypes in the FLAP gene represent an independent genetic susceptibility factor for MI.

Analysis of the North American cohort (described in Example 12) identified another haplotype C which is associated with MI as demonstrated in Table 35 (Example 13). HapC is defined by the T allele of marker SG13S375. There are 4 additional variations of the HapC haplotype which comprise SNPs in addition to the T allele of SG13S375.

HapC2 is defined by allele T of the SNPs SG13S375 and allele G of the SNP SG13S25. HapC3 is defined by allele T of the SNPs SG13S375 and allele G of the SNP SG13S25 and allele A of SNP SG13S32. HapC4-A is defined by allele G of the SNP SG13S106 in addition to allele T of the SNPs SG13S375, allele G of the SNP SG13S25 and allele A of SNP SG13S32. HapC4-B is defined by allele A of the SNP SG13S106 in addition to allele T of the SNPs SG13S375, allele G of the SNP SG13S25 and allele A of SNP SG13S32. HapC4-A correlates with HapA and HapB.

In addition, genetic analysis in Icelandic and North American cohorts (Examples 17) identified LTA4H haplotypes associated MI as demonstrated in Tables 42 and 44. HapK is defined by allele C of the SNPs SG12S16, allele G of the SNPs SG12S21, allele T of the SNPs SG12S23, allele A of the SNPs SG12S25, allele T of the SNPs SG12S26, allele T of the SNPs SG12S100, allele T of the SNPs SG12S28, allele C of the SNPs SG12S143, allele G of the SNPs SG12S144, and allele G of the SNPs SG12S221.

For Icelandic and European American cohorts, essentially the HapK association to MI can be obtained by analyzing the following 5 SNPs: allele A of the SNPs SG12S25, allele T of the SNPs SG12S26, allele C of the SNPs SG12S143, allele G of the SNPs SG12S144, and allele G of the SNPs SG12S221. However, for African American cohorts, the HapK association to MI can be obtained analyzing the following 7 SNPs: allele A of the SNPs SG12S25, allele T of the SNPs SG12S26, allele T of the SNPs SG12S100, allele T of the SNPs SG12S28, allele C of the SNPs SG12S143, allele G of the SNPs SG12S144, and allele G of the SNPs SG12S221. The addition of these two SNPs to the 5 SNPs that define HapK adds additional information to improve accuracy of determination of the carrier status of a tested individual for this haplotype. This extra information is more helpful in African-American cohorts than Caucasian since there is a greater diversity of haplotypes in African-Americans, although the 5-SNP HapK has good accuracy for determining carrier status in African-Americans. Single SNPs, such as SG12S551 with allele T and SG12S540 with allele A, have been defined that are highly correlated to HapK and can in large measure substitute for HapK in terms of defining MI risk.

HapL is defined by allele C of the SNPs SG12S16, allele G of the SNPs SG12S21, allele T of the SNPs SG12S23, allele A of the SNPs SG12S25, allele T of the SNPs SG12S26, allele T of the SNPs SG12S100, allele T of the SNPs SG12S28, allele T of the SNPs SG12S143, allele A of the SNPs SG12S144, and allele G of the SNPs SG12S221. HapQ is defined by allele C of the SNPs SG12S16, allele G of the SNPs SG12S21, allele T of the SNPs SG12S23, allele G of the SNPs SG12S25, allele T of the SNPs SG12S26, allele C of the SNPs SG12S100, allele T of the SNPs SG12S28, allele T of the SNPs SG12S143, allele A of the SNPs SG12S144, and allele G of the SNPs SG12S221.

Because stroke and PAOD are diseases that are closely related to MI (all occur on the basis of atherosclerosis), the SNP haplotype in the FLAP gene that confers risk to MI was assessed to determine whether it also conferred risk of stroke and/or PAOD. Table 21 shows that haplotype A4 increases the risk of having a stroke to a similar extent as it increases the risk of having an MI. Table 37 demonstrates that HapA is associated with risk of stroke in a Scottish chort (Example 14). Although not as significantly, haplotype A4 also confers risk of developing PAOD.

The FLAP nucleic acid encodes a 5-lipoxygenase activating protein, which, in combination with 5-lipoxygenase (5-LO), is required for leukotriene synthesis. FLAP acts coordinately with 5-LO to catalyze the first step in the synthesis of leukotrienes from arachidonic acid. It catalyzes the conversion of arachidonic acid to 5(S)-hydroperoxy-6-trans-8,11, 14-cis-eicosatetraenoic acid (5-HPETE), and further to the allylic epoxide 5 (S)-trans7,9 trans 11,14-cis-eicosatetraenoic acid (leukotriene A4, LTA4).

The leukotrienes are a family of highly potent biological mediators of inflammatory processes produced primarily by bone marrow derived leukocytes such as monocytes, macrophages, and neurophils. Both FLAP and 5-LO are detected within atherosclerosis lesions (Proc Natl Acad Sci U S A. 2003 Feb. 4;100(3):1238-43.), indicating that the vessel itself can be a source of leukotrienes. It was found at first that the MI-risk FLAP haplotype was associated with higher serum leukotriene levels. Increased production of leukotriene in individuals with pre-existing atherosclerosis lesions may lead to plaque instability or friability of the fibrous cap leading to local thrombotic events. If this occurs in coronary artery arteries it leads to MI or unstable angina. If it occurs in the cerebrovasculature it leads to stroke or transient ischemic attack. If it occurs in large arteries to the limbs, it causes or exacerbates limb ischemia in persons with peripheral arterial occlusive disease (PAOD). Therefore, those with genetically influenced predisposition to produce higher leukotriene levels have higher risk for events due to pre-existing atherosclerosis such as MI.

Inhibitors of FLAP function impede translocation of 5-LO from the cytoplasm to the cell membrane and inhibit activation of 5-LO and thereby decrease leukotriene synthesis.

As a result of these discoveries, methods are now available for the treatment of myocardial infarction (MI) and acute coronary syndrome (ACS), as well as stroke and PAOD, through the use of leukotriene inhibitors, such as agents that inhibit leukotriene biosynthesis or antagonize signaling through leukotriene receptors. The term, "treatment" as used herein, refers not only to ameliorating symptoms associated with the disease or condition, but also preventing or delaying the onset of the disease or condition; preventing or delaying the occurrence of a second episode of the disease or condition; and/or also lessening the severity or frequency of symptoms of the disease or condition. In the case of atherosclerosis, "treatment" also refers to a minimization or reversal of the development of plaques. Methods are additionally available for assessing an individual's risk for MI, ACS, stroke or PAOD. In a preferred embodiment, the individual to be treated is an individual who is susceptible (at increased risk) for MI, ACS, stroke or PAOD, such as an individual who is in one of the representative target populations described herein.

Representative Target Populations

In one embodiment of the invention, an individual who is at risk for MI, ACS, stroke or PAOD is an individual who has an at-risk haplotype in FLAP, as described herein. In one embodiment, a haplotype associated with a susceptibility to myocardial infarction, ACS, stroke or PAOD comprises markers SG13S99, SG13S25, SG13S377, SG13S106, SG13S32 and SG13S35 at the 13q12-13 locus. In another embodiment, a haplotype associated with a susceptibility to myocardial infarction, ACS, stroke or PAOD comprises markers SG13S99, SG13S25, SG13S106, SG13S30 and SG13S42 at the 13q12 locus. In a third embodiment, a haplotype associated with a susceptibility to myocardial infarction, ACS, stroke or PAOD comprises markers SG13S25, SG13S106, SG13S30 and SG13S42 at the 13q12-13 locus. In a fourth embodiment, a haplotype associated with a susceptibility to myocardial infarction, ACS, stroke or PAOD comprises markers SG13S99, SG13S25, SG13S114, SG13S89 and SG13S32 at the 13q12-13 locus. In a fifth embodiment, a haplotype associated with a susceptibility to myocardial infarction, ACS, stroke or PAOD comprises markers SG13S25, SG13S114, SG13S89 and SG13S32 at the 13q12-13 locus. In another embodiment, a haplotype associated with a susceptibility to myocardial infarction, ACS, stroke or PAOD comprises marker SG13S375 at the 13q12-13 locus. In another embodiment, a haplotype associated with a susceptibility to myocardial infarction, ACS, stroke or PAOD comprises markers SG13S25 and SG13S375 at the 13q12-13 locus. In another embodiment, a haplotype associated with a susceptibility to myocardial infarction, ACS, stroke or PAOD comprises markers SG13S25, SG13S375 and SG13S32 at the 13q12-13 locus. In an additional embodiment, a haplotype associated with a susceptibility to myocardial infarction, ACS, stroke or PAOD comprises markers SG13S25, SG13S375, SG13S32 and SG13S106 at the 13q12-13 locus. Additional haplotypes associated with a susceptibility to myocardial infarction, ACS, stroke or PAOD include the haplotypes shown in Tables 5, 7, 8, 9, 10 14, 15, 17 and 19, as well as haplotypes comprising markers shown in Table 13.

Increased risk for MI, ACS, stroke or PAOD in individuals with a FLAP at-risk haplotype is logically conferred by increased production of leukotrienes in the arterial vessel wall or in bone-marrow derived inflammatory cells within the blood and/or arterial vessel wall. It is shown herein that FLAP at-risk haplotypes are associated with higher production of LTB4 ex vivo. It is further shown herein that serum leukotriene levels (specifically, leukotriene E4) correlate with serum CRP levels in myocardial infarction patients. FLAP genetic variation may drive high leukotriene levels (within the blood vessel and/or systemically), which in turn may drive higher CRP levels which has been shown as a risk factor for MI. Accordingly, individuals with a FLAP at-risk haplotype are likely to have elevated serum CRP as well as other serum inflammatory markers. The level of serum CRP or other serum inflammatory markers can be used as a surrogate for the level of arterial wall inflammation initiated by lipid deposition and atherogenesis conferred by the presence of the at-risk FLAP haplotype.

In another embodiment of the invention, an individual who is at risk for MI, ACS, stroke or PAOD is an individual who has a polymorphism in a FLAP gene, in which the presence of the polymorphism is indicative of a susceptibility to MI, ACS, stroke or PAOD. The term "gene," as used herein, refers to not only the sequence of nucleic acids encoding a polypeptide, but also the promoter regions, transcription enhancement elements, splice donor/acceptor sites, and other non-transcribed nucleic acid elements. Representative polymorphisms include those presented in Table 13, below.

In a further embodiment of the invention, an individual who is at risk for MI, ACS, stroke or PAOD is an individual who has an at-risk polymorphism in the 5-LO gene in the promoter region, as described herein.

In one embodiment of the invention, an individual who is at risk for MI or ACS is an individual who has an at-risk haplotype in LTA4H, as described herein. In one embodiment, the haplotype can comprise alleles 0, T, 0, and A, of markers DG12S1664, SG12S26, DG12S1666, and SG12S144, respectively, at the 12q23 locus. This LTA4H "at-risk" haplotype is detected in over 76% of male patients who have previously had an MI, conferring an increased relative risk of 1.4 fold and in 72% of female MI patients with a relative risk of 1.2. Increased risk for MI or ACS in individuals with an LTA4H at-risk haplotype is logically conferred by increased production of leukotrienes in the arterial vessel wall or in bone-marrow derived inflammatory cells within the blood and/or arterial vessel wall. In another embodiment of the invention, an individual who is at risk for MI or ACS is an individual who has a polymorphism in an LTA4H gene, in which the presence of the polymorphism is indicative of a susceptibility to MI or ACS. The term "gene," as used herein, refers to not only the sequence of nucleic acids encoding a polypeptide, but also the promoter regions, transcription enhancement elements, splice donor/acceptor sites, and other non-transcribed nucleic acid elements. Representative polymorphisms include those presented in Table 40. Along the same lines, certain variants in the FLAP gene and other members of the leukotriene biosynthetic and response pathway (see, U.S. Provisional Application No. 60/419,432, filed on Oct. 17, 2002; U.S. patent application Ser. No. 10/829,674, filed on Apr. 22, 2004 (now U.S. Pat. No. 7,507,531) may indicate one's increased risk for MI and ACS. Other representatibe at-risk haplotypes are shown in Table 41 and Table 42. Additional "at-risk" haplotypes can be determined using linkage disequilibrium and/or haplotype blocks.

In an embodiment, an individual who is at risk for MI, ACS, stroke or PAOD is an individual who has an elevated inflammatory marker. An "elevated inflammatory marker," as used herein, is the presence of an amount of an inflammatory marker that is greater, by an amount that is statistically significant, than the amount that is typically found in control individual(s) or by comparison of disease risk in a population associated with the lowest band of measurement (e.g., below the mean or median, the lowest quartile or the lowest quintile) compared to higher bands of measurement (e.g., above the mean or median, the second, third or fourth quartile; the second, third, fourth or fifth quintile). An "inflammatory marker" refers to a molecule that is indicative of the presence of inflammation in an individual, for example, C-reactive protein (CRP), serum amyloid A, fibrinogen, leukotriene levels (e.g., leukotriene B4, leukotriene C4), leukotriene metabolites (e.g., leukotriene E4), interleukin-6, tissue necrosis factor-alpha, soluble vasculare cell adhesion molecules (sVCAM), soluble intervascular adhesion molecules (sI-CAM), E-selectin, matrix metalloprotease type-1, matrix metalloprotease type-2, matrix metalloprotease type-3, matrix metalloprotease type-9, myeloperoxidase (MPO), N-tyrosine) or other markers (see, e.g., Doggen, C. J. M. et al., *J. Internal Med.,* 248:406-414 (2000); Ridker, P. M. et al., *New Englnd. J. Med.* 1997: 336: 973-979, Rettersol, L. et al., 2002: 160:433-440; Ridker, P. M. et. al., *New England. J. Med.,* 2002: 347: 1557-1565; Bermudez, E. A. et. al., *Arterioscler. Thromb. Vasc. Biol.,* 2002: 22:1668-167). In certain embodiments, the presence of such inflammatory markers can be measured in serum or urine.

In an embodiment, an individual who is at risk for MI, ACS, stroke or PAOD is an individual who has increased LDL cholesterol and/or decreased HDL cholesterol levels. For example, the American Heart Association indicates that an LDL cholesterol level of less than 100 mg/dL is optimal; from 100-129 mg/dL is near/above optimal; from 130-159 mg/dL is borderline high; from 160-189 is high; and from 190 and up is very high. Therefore, an individual who is at risk for MI, ACS, stroke or PAOD because of an increased LDL cholesterol level is, for example, an individual who has more than 100 mg/dL cholesterol, such as an individual who has a near/above optimal level, a borderline high level, a high level or a very high level. Similarly, the American Heart Association indicates that an HDL cholesterol level of less than 40 mg/dL is a major risk factor for heart disease; and an HDL cholesterol level of 60 mg/dL or more is protective against heart disease. Thus, an individual who is at risk for MI, ACS, stroke or PAOD because of a decreased HDL cholesterol level is, for example, an individual who has less than 60 mg/dL HDL cholesterol, such as an individual who has less than 40 mg/dL HDL cholesterol.

In another embodiment, an individual who is at risk for MI, ACS, stroke or PAOD is an individual who has increased leukotriene synthesis. "Increased leukotriene synthesis," as used herein, indicates an amount of production of leukotrienes that is greater, by an amount that is statistically significant, than the amount of production of leukotrienes that is typically found in control individual(s) or by comparison of leukotriene production in a population associated with the lowest band of measurement (e.g., below the mean or median, the lowest quartile or the lowest quintile) compared to higher bands of measurement (e.g., above the mean or median, the second, third or fourth quartile; the second, third, fourth or fifth quintile). For example, the FLAP at-risk haplotypes correlate with increased serum leukotriene synthesis levels, and with increased production of leukotrienes ex vivo. An individual can be assessed for the presence of increased leukotriene synthesis by a variety of methods. For example, an individual can be assessed for an increased risk of MI, ACS, stroke, PAOD or atherosclerosis, by assessing the level of a leukotriene metabolite (e.g., LTE4) in a sample (e.g., serum, plasma or urine) from the individual. Samples containing blood, cells, or tissue can also be obtained from an individual and used to assess leukotriene or leukotriene metabolite production ex vivo under appropriate assay conditions. An increased level of leukotriene metabolites, and/or an increased level of leukotriene production ex vivo, is indicative of increased production of leukotrienes in the individual, and of an increased risk of MI, ACS, stroke, PAOD or atherosclerosis.

In a further embodiment, an individual who is at risk for MI, ACS, or stroke is an individual who has already experienced at least one MI, ACS event or stroke, or who has stable angina, and is therefore at risk for a second MI, ACS event or stroke. In another embodiment, an individual who is at risk for MI, ACS, stroke or PAOD is an individual who has atherosclerosis or who requires treatment (e.g., angioplasty, stents, revascularization procedure) to restore blood flow in arteries.

In further embodiments, an individual who is at risk for MI, stroke or PAOD is an individual having asymptomatic ankle/brachial index of less than 0.9; an individual who is at risk for stroke, is an individual who has had one or more transient ischemic attacks; who has had transient monocular blindness; has had a carotid endarterectomy; or has asymptomatic carotid stenosis; an individual who is at risk for PAOD, is an individual who has (or had) claudication, limb ischemia leading to gangrene, ulceration or amputation, or has had a revascularization procedure.

In additional embodiments, an individual who is at risk for MI, ACS, stroke or PAOD is an individual who has diabetes; hypertension; hypercholesterolemia; elevated triglycerides (e.g., >200 mg/dl); elevated lp(a); obesity; ankle/brachial index (ABI) less than 0.9; and/or is a past or current smoker.

Individuals at risk for MI, ACS, stroke or PAOD may fall into more than one of these representative target populations. For example, an individual may have experienced at least one MI, ACS event, transient ischemic attack, transient monocular blindness, or stroke, and may also have an increased level of an inflammatory marker. As used therein, the term "individual in a target population" refers to an individual who is at risk for MI, ACS, stroke or PAOD who falls into at least one of the representative target populations described above.

Assessment for At-Risk Haplotypes

A "haplotype," as described herein, refers to a combination of genetic markers ("alleles"), such as those set forth in Table 13. In a certain embodiment, the haplotype can comprise one or more alleles (e.g., a haplotype containing a single SNP), two or more alleles, three or more alleles, four or more alleles, or five or more alleles. The genetic markers are particular "alleles" at "polymorphic sites" associated with FLAP. A nucleotide position at which more than one sequence is possible in a population (either a natural population or a synthetic population, e.g., a library of synthetic molecules), is referred to herein as a "polymorphic site". Where a polymorphic site is a single nucleotide in length, the site is referred to as a single nucleotide polymorphism ("SNP"). For example, if at a particular chromosomal location, one member of a population has an adenine and another member of the population has a thymine at the same position, then this position is a polymorphic site, and, more specifically, the polymorphic site is a SNP. Polymorphic sites can allow for differences in sequences based on substitutions, insertions or deletions. Each version of the sequence with respect to the polymorphic site is referred to herein as an "allele" of the polymorphic site. Thus, in the previous example, the SNP allows for both an adenine allele and a thymine allele.

Typically, a reference sequence is referred to for a particular sequence. Alleles that differ from the reference are referred to as "variant" alleles. For example, the reference FLAP sequence is described herein by SEQ ID NO: 1. The term, "variant FLAP", as used herein, refers to a sequence that differs from SEQ ID NO: 1, but is otherwise substantially similar. The genetic markers that make up the haplotypes described herein are FLAP variants.

Additional variants can include changes that affect a polypeptide, e.g., the FLAP polypeptide. These sequence differences, when compared to a reference nucleotide sequence, can include the insertion or deletion of a single nucleotide, or of more than one nucleotide, resulting in a frame shift; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of a reading frame; duplication of all or a part of a sequence; transposition; or a rearrangement of a nucleotide sequence, as described in detail above. Such sequence changes alter the polypeptide encoded by a FLAP nucleic acid. For example, if the change in the nucleic acid sequence causes a frame shift, the frame shift can result in a change in the encoded amino acids, and/or can result in the generation of a premature stop codon, causing generation of a truncated polypeptide. Alternatively, a polymorphism associated with a susceptibility to MI, ACS, stroke or PAOD can be a synonymous change in one or more nucleotides (i.e., a change that does not result in a change in the amino acid sequence). Such a polymorphism can, for example, alter splice sites, affect the stability or transport of mRNA, or otherwise affect the transcription or translation of the polypeptide. The polypeptide encoded by the reference nucleotide sequence is the "reference" polypeptide with a particular reference amino acid sequence, and polypeptides encoded by variant alleles are referred to as "variant" polypeptides with variant amino acid sequences.

Haplotypes are a combination of genetic markers, e.g., particular alleles at polymorphic sites. The haplotypes described herein, e.g., having markers such as those shown in Table 13, are found more frequently in individuals with MI, ACS, stroke or PAOD than in individuals without MI, ACS, stroke or PAOD. Therefore, these haplotypes have predictive value for detecting a susceptibility to MI, ACS, stroke or PAOD in an individual. The haplotypes described herein are in some cases a combination of various genetic markers, e.g., SNPs and microsatellites. Therefore, detecting haplotypes can be accomplished by methods known in the art for detecting sequences at polymorphic sites, such as the methods described above.

In certain methods described herein, an individual who is at risk for MI, ACS, stroke or PAOD is an individual in whom an at-risk haplotype is identified. In one embodiment, the at-risk haplotype is one that confers a significant risk of MI, ACS, stroke or PAOD. In one embodiment, significance associated with a haplotype is measured by an odds ratio. In a further embodiment, the significance is measured by a percentage. In one embodiment, a significant risk is measured as an odds ratio of at least about 1.2, including by not limited to: 1.2, 1.3, 1.4, 1.5, 1.6, 1.7, 1.8, and 1.9. In a further embodiment, an odds ratio of at least 1.2 is significant. In a further embodiment, an odds ratio of at least about 1.5 is significant. In a further embodiment, a significant increase in risk is at least about 1.7 is significant. In a further embodiment, a significant increase in risk is at least about 20%, including but not limited to about 25%, 30%, 35%, 40%, 45%, 50%, 55%, 60%, 65%, 70%, 75%, 80%, 85%, 90%, 95%, and 98%. In a further embodiment, a significant increase in risk is at least about 50%. In yet another embodiment, an at-risk haplotype has a p value <0.05. It is understood however, that identifying whether a risk is medically significant may also depend on a variety of factors, including the specific disease, the haplotype, and often, environmental factors.

An at-risk haplotype in, or comprising portions of, the FLAP gene, in one where the haplotype is more frequently present in an individual at risk for MI, ACS, stroke or PAOD (affected), compared to the frequency of its presence in a healthy individual (control), and wherein the presence of the haplotype is indicative of susceptibility to MI, ACS, stroke or PAOD. As an example of a simple test for correlation would be a Fisher-exact test on a two by two table. Given a cohort of chromosomes the two by two table is constructed out of the number of chromosomes that include both of the haplotypes, one of the haplotype but not the other and neither of the haplotypes.

In certain embodiments, an at-risk haplotype is an at-risk haplotype within or near FLAP that significantly correlates with a haplotype such as a halotype shown in Table 14; a haplotype shown in Table 15; a haplotype shown in Table 19; haplotype B4; haplotype B5; haplotype B6; haplotype A4; haplotype A5; or haplotype HapB. In other embodiments, an at-risk haplotype comprises an at-risk haplotype within or near FLAP that significantly correlates with susceptibility to myocardial infarction or stroke. In a particular embodiment, a haplotype associated with a susceptibility to myocardial infarction, ACS, stroke or PAOD comprises markers SG13S99, SG13S25, SG13S377, SG13S106, SG13S32 and SG13S35 at the 13q12-13 locus. In another embodiment, a haplotype associated with a susceptibility to myocardial infarction, ACS, stroke or PAOD comprises markers SG13S99, SG13S25, SG13S106, SG13S30 and SG13S42 at the 13q12-13 locus. In a third embodiment, a haplotype associated with a susceptibility to myocardial infarction, ACS, stroke or PAOD comprises markers SG13S25, SG13S106, SG13S30 and SG13S42 at the 13q12-13 locus. In a fourth embodiment, a haplotype associated with a susceptibility to myocardial infarction, ACS, stroke or PAOD comprises markers SG13S99, SG13S25, SG13S114, SG13S89 and SG13S32 at the 13q12-13 locus. In another embodiment, a haplotype associated with a susceptibility to myocardial infarction, ACS, stroke or PAOD comprises marker SG13S375 at the 13q12-13 locus. In another embodiment, a haplotype associated with a susceptibility to myocardial infarction, ACS, stroke or PAOD comprises markers SG13S25 and SG13S375 at the 13q12-13 locus. In another embodiment, a haplotype associated with a susceptibility to myocardial infarction, ACS, stroke or PAOD comprises markers SG13S25, SG13S375 and SG13S32 at the 13q12-13 locus. In an additional embodiment, a haplotype associated with a susceptibility to myocardial infarction, ACS, stroke or PAOD comprises markers SG13S25, SG13S375, SG13S32 and SG13S106. In other embodiments, the at-risk haplotype is selected from the group consisting of: haplotype B4, B5, B6, A4, A5, C1, C2, C3, C4-A and C4-B. The at-risk haplotype can also comprise a combination of the markers in the haplotypes B4, B5, B6, A4, A5, C1, C2, C3, C4-A and/or C4-B. In further embodiments, the at-risk haplotype can be haplotype HapB. In other embodiments, the at-risk haplotype comprises a polymorphism shown in Table 13.

Standard techniques for genotyping for the presence of SNPs and/or microsatellite markers can be used, such as fluorescent based techniques (Chen, et al., *Genome Res.* 9, 492 (1999)), PCR, LCR, Nested PCR and other techniques for nucleic acid amplification. In a preferred embodiment, the method comprises assessing in an individual the presence or frequency of SNPs and/or microsatellites in, comprising portions of, the FLAP gene, wherein an excess or higher frequency of the SNPs and/or microsatellites compared to a healthy control individual is indicative that the individual is susceptible to MI, ACS, stroke or PAOD. See, for example, Table 13 (below) for SNPs and markers that can form haplotypes that can be used as screening tools. These markers and SNPs can be identified in at-risk haplotypes. For example, an at-risk haplotype can include microsatellite markers and/or SNPs such as those set forth in Table 13. The presence of the haplotype is indicative of a susceptibility to MI, ACS, stroke or PAOD, and therefore is indicative of an individual who falls within a target population for the treatment methods described herein.

Haplotype analysis involves defining a candidate susceptibility locus using LOD scores. The defined regions are then ultra-fine mapped with microsatellite markers with an average spacing between markers of less than 100 kb. All usable microsatellite markers that are found in public databases and mapped within that region can be used. In addition, microsatellite markers identified within the deCODE genetics sequence assembly of the human genome can be used. The frequencies of haplotypes in the patient and the control groups can be estimated using an expectation-maximization algorithm (Dempster A. et al., 1977. *J. R. Stat. Soc. B,* 39:1-389). An implementation of this algorithm that can handle missing genotypes and uncertainty with the phase can be used. Under the null hypothesis, the patients and the controls are assumed to have identical frequencies. Using a likelihood approach, an alternative hypothesis is tested, where a candidate at-risk-haplotype, which can include the markers described herein, is allowed to have a higher frequency in patients than controls, while the ratios of the frequencies of other haplotypes are assumed to be the same in both groups. Likelihoods are maximized separately under both hypotheses and a corresponding 1-df likelihood ratio statistic is used to evaluate the statistic significance.

To look for at-risk-haplotypes in the 1-lod drop, for example, association of all possible combinations of genotyped markers is studied, provided those markers span a practical region. The combined patient and control groups can be randomly divided into two sets, equal in size to the original group of patients and controls. The haplotype analysis is then repeated and the most significant p-value registered is determined. This randomization scheme can be repeated, for example, over 100 times to construct an empirical distribution of p-values. In a preferred embodiment, a p-value of <0.05 is indicative of an at-risk haplotype.

A detailed discussion of haplotype analysis is described in International Application No. PCT/US03/32556, filed on Oct. 16, 2003, which is incorporated by reference herein in its entirety.

Methods of Treatment

The present invention encompasses methods of treatment (prophylactic and/or therapeutic, as described above) for MI, ACS, stroke or PAOD in individuals, such as individuals in the target populations described above, as well as for other diseases and conditions associated with FLAP or with other members of the leukotriene pathway (e.g., for atherosclerosis). Members of the "leukotriene pathway," as used herein, include polypeptides (e.g., enzymes, receptors) and other molecules that are associated with production of leukotrienes: for example, proteins or enzymes such as FLAP, 5-LO, other leukotriene biosynthetic enzymes (e.g., leukotriene C4 synthase, leukotriene A4 hydrolase); receptors or binding agents of the enzymes; leukotrienes such as LTA4, LTB4, LTC4, LTD4, LTE4; and receptors of leukotrienes (e.g., leukotriene B4 receptor 1 (BLT1), leukotriene B4 receptor 2 (BLT2), cysteinyl leukotriene receptor 1 (CysLTR1), cysteinyl leukotriene receptor 2 (CysLTR2)).

In particular, the invention relates to methods of treatment for myocardial infarction or susceptibility to myocardial infarction (for example, for individuals in an at-risk population such as those described above); as well as methods of treatment for acute coronary syndrome (e.g., unstable angina, non-ST-elevation myocardial infarction (NSTEMI) or ST-elevation myocardial infarction (STEMI)); methods for reducing risk of MI, stroke or PAOD in persons with asymptomatic ankle/brachial index less than 0.9; for decreasing risk of a second myocardial infarction; for stroke or susceptibility to stroke; for transient ischemic attack; for transient monocular blindness; for decreasing risk of a second stroke; for PAOD or susceptibility to PAOD; for ABI less than 0.9; for claudication or limb ischemia; for atherosclerosis, such as for patients requiring treatment (e.g., angioplasty, stents, revascularization procedure) to restore blood flow in arteries (e.g., coronary, carotid, and/or femoral arteries); for treatment of asymptomatic ankle/brachial index of less than 0.9; and/or for decreasing leukotriene synthesis (e.g., for treatment of MI, ACS, stroke or PAOD). The invention additionally pertains to use of one or more leukotriene synthesis inhibitors, as described herein, for the manufacture of a medicament for the treatment of MI, ACS, stroke, PAOD and/or atherosclerosis, e.g., using the methods described herein. The invention also provides for the use of one or more leukotriene synthesis inhibitors, as described herein, for the manufacture of a medicament for reducing the risk for MI, ACS, PAOD, stroke and/or artherosclerosis using the methods described herein. These medicaments may comprise a leukotriene synthesis inhibitor alone or in combination with a statin, as described herein.

In the methods of the invention, a "leukotriene synthesis inhibitor" is used. In one embodiment, a "leukotriene synthesis inhibitor" is an agent that inhibits FLAP polypeptide activity and/or FLAP nucleic acid expression, as described herein (e.g., a nucleic acid antagonist). In another embodiment, a leukotriene synthesis inhibitor is an agent that inhibits polypeptide activity and/or nucleic acid expression of another member of the leukotriene biosynthetic pathway (e.g., 5-LO; LTC4S; LTA4H; LTB4DH). In still another embodiment, a leukotriene synthesis inhibitor is an agent that alters activity or metabolism of a leukotriene (e.g., an antagonist of a leukotriene; an antagonist of a leukotriene receptor). In preferred embodiments, the leukotriene synthesis inhibitor alters activity and/or nucleic acid expression of FLAP or of 5-LO, or alters interaction between FLAP and 5-LO.

Leukotriene synthesis inhibitors can alter polypeptide activity or nucleic acid expression of a member of the leukotriene pathway by a variety of means, such as, for example, by catalytically degrading, downregulating or interfering with the expression, transcription or translation of a nucleic acid encoding the member of the leukotriene pathway; by altering posttranslational processing of the polypeptide; by altering transcription of splicing variants; or by interfering with polypeptide activity (e.g., by binding to the polypeptide, or by binding to another polypeptide that interacts with that member of the leukotriene pathway, such as a FLAP binding agent as described herein or some other binding agent of a member of the leukotriene pathway; by altering interaction among two or more members of the leukotriene pathway (e.g., interaction between FLAP and 5-LO); or by antagonizing activity of a member of the leukotriene pathway.

Representative leukotriene synthesis inhibitors include the following: agents that inhibit activity of a member of the leukotriene biosynthetic pathway (e.g., FLAP, 5-LO), LTC4S, LTA4H, such as the agents presented in the Agent Tables I and II herein; agents that inhibit activity of receptors of members of the leukotriene pathway, such as FLAP receptors, LTA4 receptors, LTB4 receptors ( e.g. BLT 1, BLT2), LTC4 receptors, LTD4 receptors, LTE4 receptors, Cys LT1 receptors, Cys LT2 receptors, 5-LO receptors; BLT1; BLT2; CysLTR1; CysLTR2; agents that bind to the members of the leukotriene pathway, such as FLAP binding agents (e.g., 5-LO) or agents that bind to receptors of members of the leukotriene pathway (e.g., leukotriene receptor antagonists); agents that bind to a leukotriene (e.g., to LTA4, LTB4, LTC4, LTD4, LTE4, Cys LT1, Cys LT2); agents that increase breakdown of leukotrienes (e.g., LTB4DH); or other agents that otherwise affect (e.g., increase or decrease) activity of the leukotriene;

antibodies to leukotrienes;

antisense nucleic acids or small double-stranded interfering RNA, to nucleic acids encoding FLAP, 5-LO, LTA4H, or a leukotriene synthetase or other member of the leukotriene pathway, or fragments or derivatives thereof, including antisense nucleic acids to nucleic acids encoding the FLAP, 5-LO or leukotriene synthetase polypeptides, and vectors comprising such antisense nucleic acids (e.g., nucleic acid, cDNA, and/or mRNA, double-stranded interfering RNA, or a nucleic acid encoding an active fragment or derivative thereof, or an oligonucleotide; for example, the complement of one of SEQ ID Nos. 1, 3, 718 or 719, or a nucleic acid complementary to the nucleic acid encoding SEQ ID NO: 2 or 718, or fragments or derivatives thereof);

peptidomimetics; fusion proteins or prodrugs thereof; ribozymes; other small molecules; and other agents that alter (e.g., inhibit or antagonize) expression of a member of the leukotriene pathway, such as FLAP, 5-LO or LTA4H nucleic acid expression or polypeptide activity, or that regulate transcription of FLAP splicing variants, 5-LO splicing variants or LTA4H splicing variants(e.g., agents that affect which splicing variants are expressed, or that affect the amount of each splicing variant that is expressed).

More than one leukotriene synthesis inhibitor can be used concurrently, if desired.

The therapy is designed to alter activity of a FLAP polypeptide, a 5-LO polypeptide, or another member of the leukotriene pathway in an individual, such as by inhibiting or antagonizing activity. For example, a leukotriene synthesis inhibitor can be administered in order to decrease synthesis of leukotrienes within the individual, or to downregulate or decrease the expression or availability of the FLAP nucleic acid or specific splicing variants of the FLAP nucleic acid. Downregulation or decreasing expression or availability of a native FLAP nucleic acid or of a particular splicing variant could minimize the expression or activity of a defective nucleic acid or the particular splicing variant and thereby minimize the impact of the defective nucleic acid or the particular splicing variant. Similarly, for example, a leukotriene synthesis inhibitor can be administered in order to downregulate or decrease the expression or availability of the nucleic acid encoding 5-LO or specific splicing variants of the nucleic acid encoding 5-LO.

The leukotriene synthesis inhibitor(s) are administered in a therapeutically effective amount (i.e., an amount that is sufficient to treat the disease or condition, such as by ameliorating symptoms associated with the disease or condition, preventing or delaying the onset of the disease or condition, and/or also lessening the severity or frequency of symptoms of the disease or condition). The amount which will be therapeutically effective in the treatment of a particular individual's disease or condition will depend on the symptoms and severity of the disease, and can be determined by standard clinical techniques. In addition, in vitro or in vivo assays may optionally be employed to help identify optimal dosage ranges. The precise dose to be employed in the formulation will also depend on the route of administration, and the seriousness of the disease or disorder, and should be decided according to the judgment of a practitioner and each patient's circumstances. Effective doses may be extrapolated from dose-response curves derived from in vitro or animal model test systems.

In preferred embodiments of the invention, the leukotriene synthesis inhibitor agent is an agent that inhibits activity of FLAP and/or of 5-LO. Preferred agents include the following, as set forth in Agent Table I below:

AGENT TABLE I

| Company | Product_Name (Code) | Structure | Chemical Name | Patent Ref | Date Patent Issued/Application Published | MOA |
|---|---|---|---|---|---|---|
| Abbott | atreleuton (ABT-761) | | (R)-(+)-N-[3]5-[(4-fluorophenyl)methyl]-2thienyl]-1methyl-2-propynyl]-N-hydroxyurea | U.S. Pat. No. 5288751, U.S. Pat. No. 5288743, U.S. Pat. No. 5616596 | Feb. 22, 1994 Apr. 01, 1997 | 5-LPO inhibitor |
| Abbott | A-81834 | | 3-(3-(1,1-dimethylethylthio-5-(quinoline-2-ylmethoxy)-1-(4-chloromethylphenyl)indole-2-yl)-2,2-dimethylpropionaldehyde oxime-0-2-acetic acid | WO9203132, U.S. Pat. No. 5459150 | Mar. 5, 1992, Oct. 17, 1995 | FLAP inhibitor |
| Abbott | A-86886 | | 3-(3-(1,1-dimethylethylthio-5-(pyridin-2-ylmethoxy)-1-(4-chloromethylphenyl)indole-2-yl)-2,2-dimethylpropionaldehyde oxime-0-2-acetic acid | WO9203132, U.S. Pat. No. 5459150 | Mar. 5, 1992, Oct. 17, 1995 | 5-LPO inhibitor |

AGENT TABLE I-continued

| Company | Product_Name (Code) | Structure | Chemical Name | Patent Ref | Date Patent Issued/Application Published | MOA |
|---|---|---|---|---|---|---|
| Abbott | A-93178 | 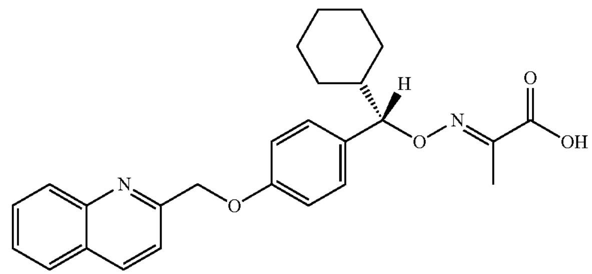 | | | | FLAP inhibitor |
| AstraZeneca | AZD-4407 | | | EP 623614 | Sep. 11, 1994 | 5-LPO inhibitor |
| AstraZeneca | ZD-2138 | | 6-((3-fluoro-5-(tetrahydro-4-methoxy-2H-pyran-4yl)phenoxy)methyl)-1-methyl-2(1H)-quinolinone (alternatively NH can be N-methyl) | EP 466452 | | 5-LPO inhibitor |

AGENT TABLE I-continued

| Company | Product_Name (Code) | Structure | Chemical Name | Patent Ref | Date Patent Issued/Application Published | MOA |
|---|---|---|---|---|---|---|
| Bayer | BAY-X-1005 | 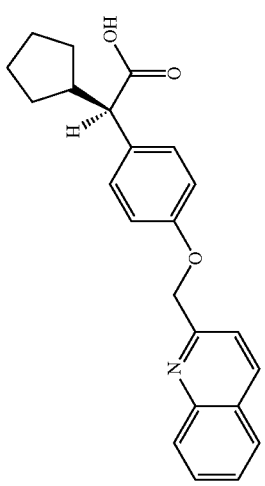 | (R)-(+)-alpha-cyclopentyl 4-(2-quinolinylmethoxy)-Benzeneacetic acid | U.S. Pat. No. 4970215 EP 344519, DE 19880531 | | FLAP inhibitor |
| Merck | MK-0591 | 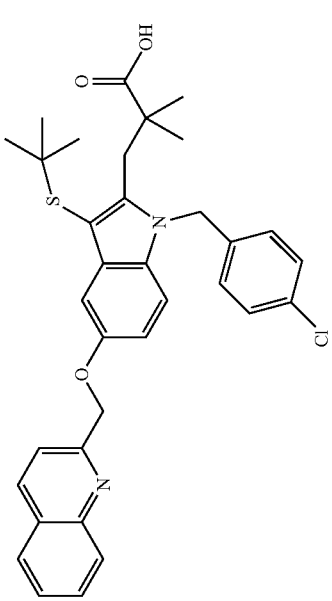 | 1-((4-chlorophenyl)methyl)-3-(((1,1-dimethylethyl)thio)-alpha, alpha-dimethyl-5-(2-quinolinylmethoxy)-1H-Indole-2-propanoic acid | EP 419049, U.S. Pat. No. 19890822 | | FLAP inhibitor |
| Merck | MK-866 | | (3[3-)4-chlorobenzyl)-3-t-butyl-thio-5-isopropylindol-2yl]2,2-dimethyl-proanoic acid | | | 5-LPO inhibitor |

AGENT TABLE I-continued

| Company | Product_Name (Code) | Structure | Chemical Name | Patent Ref | Date Patent Issued/Application Published | MOA |
|---|---|---|---|---|---|---|
| Merck | MK-886 | 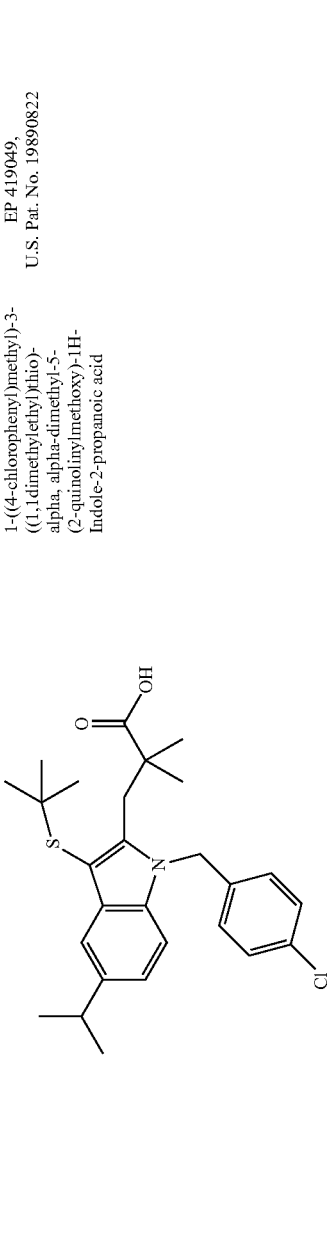 | 1-((4-chlorophenyl)methyl)-3-(((1,1dimethylethyl)thio)-alpha, alpha-dimethyl-5-(2-quinolinylmethoxy)-1H-Indole-2-propanoic acid | EP 419049, U.S. Pat. No. 19890822 | | 5-LPO inhibitor |
| Pfizer | CJ-13610 | | 4-(3-(4-(2-Methyl-imidazol-1-yl)-phenylsulfanyl)-phenyl)-tetrahydro-pyran-4-carboxylic acid amide | | | 5-LPO inhibitor |

In preferred methods of the invention, the agents set forth in the Agent Table III can be used for prophylactic and/or therapeutic treatment for diseases and conditions associated with FLAP or with other members of the leukotriene pathway, or with increased leukotriene synthesis. In particular, they can be used for treatment for myocardial infarction or susceptibility to myocardial infarction, such as for individuals in an at-risk population as described above, (e.g., based on identified risk factors such as elevated cholesterol, elevated C-reactive protein, and/or genotype); for individuals suffering from acute coronary syndrome, such as unstable angina, non-ST-elevation myocardial infarction (NSTEMI) or ST-elevation myocardial infarction (STEMI); methods for reducing risk of MI, stroke or PAOD in persons with asymptomatic ankle/brachial index less than 0.9; for decreasing risk of a subsequent myocardial infarction, such as in individuals who have already had one or more myocardial infarctions; for stroke or susceptibility to stroke; for decreasing risk of a second stroke; for PAOD or susceptibility to PAOD; for treatment of atherosclerosis, such as in patients requiring treatment (e.g., angioplasty, stents, revascularization procedure) to restore blood flow in arteries (e.g., coronary, carotid, and/or femoral arteries); for treatment of asymptomatic ankle/brachial index of less than 0.9; and/or for decreasing leukotriene synthesis (e.g., for treatment of myocardial infarction, ACS, stroke or PAOD In one preferred embodiment of the invention, the leukotriene synthesis inhibitor is an inhibitor of FLAP such as 1-((4-chlorophenyl)methyl)-3-((1,1-dimethylethyl)thio)-alpha,alpha-dimethyl-5-(2-quinolinylmethoxy)-1H-Indole-2-propanoic acid otherwise known as MK-0591, (R)-(+)-alpha-cyclopentyl-4-(2-quinolinylmethoxy)-Benzeneacetic acid otherwise known as BAY-x-1005, 3-(3-(1,1-dimethylethylthio-5-(quinoline-2-ylmethoxy)-1-(4-chloromethylphenyl)indole-2-yl)-2,2-dimethylpropionaldehyde oxime-0-2-acetic acid otherwise known as A-81834, their optically pure enantiomers, salts, chemical derivatives, analogues, or other compounds inhibiting FLAP that effectively decrease leukotriene biosynthesis when administered to humans.

In another preferred embodiment of the invention, the leukotriene synthesis inhibitor is an inhibitor of 5LO such as zileuton, atreleuton, 6-((3-fluoro-5-(tetrahydro-4-methoxy-2H-pyran-4yl)phenoxy)methyl)-1-methyl-2(1H)-quinlolinone otherwise known as ZD-2138, 1-((4-chlorophenyl)methyl)-3-((1,1dimethylethyl)thio)-alpha,alpha-dimethyl-5-(2-quinolinylmethoxy)-1H-Indole-2-propanoic acid otherwise known as MK-886, 4-(3-(4-(2-Methyl-imidazol-1-yl)-phenylsulfanyl)-phenyl)-tetrahydro-pyran-4-carboxylic acid amide otherwise known as CJ-13610, their optically pure enantiomers, salts, chemical derivatives, analogues or other compounds inhibiting 5-LO that effectively decrease leukotriene biosynthesis when administered to humans.

The compound can be represented by the following formula:

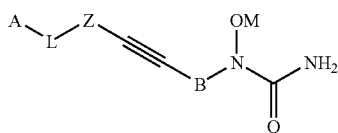

in M is selected from the group consisting of hydrogen, a pharmaceutically acceptable cation, and a pharmaceutically acceptable metabolically cleavable group; B is a straight or branched divalent alkylene group of from one to twelve carbon atoms; Z is thiazolyl, optionally substituted with alkyl of from one to six carbon atoms or haloalkyl of from one to six carbon atoms; L is selected from the group consisting of (a) alkylene of from 1-6 carbon atoms, (b) alkenylene of from 2-6 carbon atoms, (c) alkynylene of from 2-6 carbon atoms, (d) hydroxyalkyl of 1-6 carbon atoms, (e) >C=O, (f) >C=N—$OR_1$, where $R_1$ is hydrogen or $C_1$-$C_6$ alkyl, (g) –$(CHR1)_n$$(CO)(CHR_2)_m$, where n and m are independently selected from an integer from one to six and $R_1$ and $R_2$ are independently selected from hydrogen and $C_1$-$C_6$-alkyl, (h) —$(CHR_1)_n$C=$NOR_2$, where $R_1$, $R_2$ and n are as defined above; (i) —$(CHR_1)_n$ON=$CR_2$, where $R_1$, $R_2$ and n are as: defined above; (j) —$(CHR_1)_n$—O—$(CHR_2)_m$—, where $R_1$, $R_2$, n and m are as defined above, (k) —$(CHR_1)_n$—$NR_2$$(CHR_3)_m$—, where $R_1$, $R_2$, n and m are as defined above and $R_3$ is selected from hydrogen and $C_1$-$C_6$-alkyl; (l) —$(CHR_1)_n$—S—$CHR_2)_m$—, where $R_1$, $R_2$, n and m are as defined above; and (m) —$(CHR_1)_n$—$(SO_2)$—$(CHR_2)_m$—, where $R_1$, $R_2$, n and m are as defined above; A is carbocyclic aryl optionally substituted with alkyl of from one to six carbon atoms, haloalkyl of from one to six carbon atoms, hydroxyalkyl of from one to six carbon atoms, alkoxy of from one to twelve carbon atoms, alkoxyalkoxyl in which the two alkoxy portions may each independently contain from one to six carbon atoms, alkylthio of from one to six carbon atoms, hydroxy, halogen, cyano, amino, alkylamino of from one to six carbon atoms, dialkylamino in which the two alkyl groups may independently contain from one to six carbon atoms, alkanoylamino of from two to eight carbon atoms, N-alkanoyl-N-alkylamino in which the alkanoyl is of from two to eight carbon atoms and the alkyl group is of from one to six carbon atoms, alkylaminocarbonyl of from two to eight carbon atoms, dialkylaminocarbonyl in which the two alkyl groups are independently of from one to six carbon atoms, carboxyl, alkoxycarbonyl or from two to eight carbon atoms, phenyl, optionally substituted with alkyl of from one to six carbon atoms, haloalkyl of from one to six carbon atoms, alkoxy of from one to six carbon atoms, hydroxy or halogen, phenoxy, optionally substituted with alkyl of from one to six carbon atoms, haloalkyl of from one to six carbon atoms, alkoxy of from one to six carbon atoms, hydroxy or halogen, and phenylthio, optionally substituted with alkyl of from one to six carbon atoms, haloalkyl of from one to six carbon atoms, alkoxy of from one to six carbon atoms, hydroxy or halogen. Preferably, the compound is a compound or pharmaceutically acceptable salt thereof having the name (R)—N-{3-[-5-(4-fluorophenylmethyl)thiazo-2-yl]-1methyl-2-propynyl}-N-hydroxyurea. See U.S. Pat. No. 4,615,596, incorporated herein by reference.

The compound is represented by the following formula:

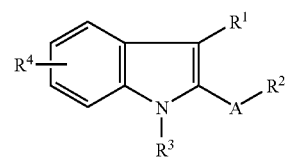

or a pharmaceutically acceptable salt thereof, wherein A is selected from the group consisting of straight or branched divalent alkylene of from one to twelve carbon atoms and divalent cycloalkylene of from three to eight carbon atoms; $R_1$ is selected from the group consisting of hydrogen, alkylthio of from one to six carbon atoms, phenylthio, optionally substituted with alkyl of from one to six carbon atoms, alkoxy of from one to six carbon atoms, or halogen, phenylalkylthio in which the alkyl portion contains from one to six carbon atoms, and the phenyl group is optionally substituted with alkyl of from one to six carbon atoms, alkoxy of from one to six carbon atoms, or halogen, $R_2$ is selected from the group consisting of COOB wherein B is selected from hydrogen, a pharmaceutically acceptable cation, or a metabolically cleavable group, —COOalkyl where the alkyl portion contains from one to six carbon atoms, —COOalkylcarbocyclicaryl where the alkyl portion contains from one to six carbon atoms and the aryl portion is optionally substituted with alkyl of from one to six carbon atoms, alkoxy of from one to six carbon atoms, or halogen, —CONR$_5$R$_6$ wherein $R_5$ is selected from the group consisting of hydrogen, hydroxyl, alkyl of from one to six carbon atoms, and alkoxy of from one to six carbon atoms, and $R_6$ is selected from the group consisting of hydrogen and alkyl of from one to six carbon atoms, —COR$_6$, and —OH; $R_3$ is selected from the group consisting of phenylalkyl in which the alkyl portion contains from one to six carbon atoms, and the phenyl group is optionally substituted with alkyl of from one to six carbon atoms, alkoxy of from one to six carbon atoms, or halogen, $R_4$ is selected from the group consisting of thiazolylalkyloxy in which the alkyl portion contains from one to six carbon atoms, and the heteroaryl portion is optionally substituted with alkyl of from one to six carbon atoms, alkoxy of from one to six carbon atoms, or halogen, and thiazolyloxy optionally substituted with alkyl of from one to six carbon atoms, alkoxy of from one to six carbon atoms, or halogen. See U.S. Pat. No. 5,288,743, incorporated herein by reference.

The compound can be represented by the formula:

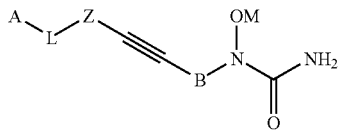

or a pharmaceutically acceptable salt thereof, wherein M is selected from the group consisting of hydrogen, and a pharmaceutically acceptable cation; B is a straight or branched divalent alkylene group of from one to twelve carbon atoms; Z is selected from the group consisting of: (a) furyl, optionally substituted with alkyl of from one to six carbon atoms, or haloalkyl of from one to six carbon atoms, and (b) thienyl, optionally substituted with alkyl of from one to six carbon atoms, or haloalkyl of from one to six carbon atoms; and L is alkylene of from 1-6 carbon atoms; A is phenyl optionally substituted with alkyl of from one to six carbon atoms, haloalkyl of from one to six carbon atoms, hydroxyalkyl of from one to six carbon atoms, alkoxy of from one to twelve carbon atoms, alkoxyalkoxyl in which the two alkoxy portions may each independently contain from one to six carbon atoms, alkylthio of from one to six carbon atoms, hydroxy, halogen, cyano, amino, alkylamino of from one to six carbon atoms, dialkylamino in which the two alkyl groups may independently contain from one to six carbon atoms, alkanoylamino of from two to eight carbon atoms, N-alkanoyl-N-alkylamino in which the alkanoyl is of from two to eight carbon atoms and the alkyl group is of from one to six carbon atoms, alkylaminocarbonyl of from two to eight carbon atoms, dialkylaminocarbonyl in which the two alkyl groups are independently of from one to six carbon atoms, carboxyl, alkoxycarbonyl of from two to eight carbon atoms, phenyl, optionally substituted with alkyl of from one to six carbon atoms, haloalkyl of from one to six carbon atoms, alkoxy of from one to six carbon atoms, hydroxy or halogen, phenoxy, optionally substituted with alkyl of from one to six carbon atoms, haloalkyl of from one to six carbon atoms, alkoxy of from one to six carbon atoms, hydroxy or halogen, or phenylthio, optionally substituted with alkyl of from one to six carbon atoms, haloalkyl of from one to six carbon atoms, alkoxy of from one to six carbon atoms, hydroxy or halogen. Preferably, the compound is a compound or a pharmaceutically acceptable salt thereof selected from the group consisting of: N-{3-(5-(4-fluorophenylmethyl)fur-2-yl)-3-butyn-2-yl}-N-hydroxyurea; N-{3-(5-(4-fluorophenylmethyl)-2-thienyl)-1-methyl-2-propynyl}-N-hydroxyurea; (R)-N-{3-(5-(4-fluorophenylmethyl)-2-thienyl)-1-methyl-2-propynyl}-N-hydroxyurea; and (R)—N-{3-(5-(4-chlorophenylmethyl)-2-thienyl)-1-methyl-2-propynyl}-N-hydroxyurea; (S)—N-{3-[5-(4-fluorophenylmethyl)-2-thienyl]-1-methyl-2-propynyl}-N-hydroxyurea. See U.S. Pat. No. 5,288,751, incorporated by reference herein.

The compound can be represented by the formula:

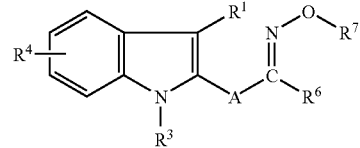

or a pharmaceutically acceptable salt thereof, wherein A is selected from the group consisting of straight or branched divalent alkylene of one to twelve carbon atoms, straight or branched divalent alkenylene of two to twelve carbon atoms, and divalent cycloalkylene of three to eight carbon atoms; $R^1$ is alkylthio of one to six carbon atoms; $R^6$ is selected from the group consisting of hydrogen and alkyl of one to six carbon atoms; $R^7$ is selected from the group consisting of (carboxyl)alkyl in which the alkyl portion is of one to six carbon atoms, (alkoxycarbonyl)alkyl in which the alkoxycarbonyl portion is of two to six carbon atoms and the alkyl portion is of one to six carbon atoms, (aminocarbonyl)alkyl in which the alkyl portion is of one to six carbon atoms, ((alkylamino)carbonyl)alkyl in which each alkyl portion independently is of one to six carbon atoms, and ((dialkylamino)carbonyl)alkyl in which each alkyl portion independently is of one to six carbon atoms; $R^3$ is phenylalkyl in which the alkyl portion is of one to six carbon atoms; $R^4$ is 2-, 3- or 6-quinolylmethoxy, optionally substituted with alkyl of one to six carbon atoms, haloalkyl of one to six carbon atoms, alkoxy of one to twelve carbon atoms, halogen, or hydroxy. Preferably, the compound is selected from the group consisting of: 3-(3-1,1-dimethylethylthio)-5-(quinolin-2-ylmethoxy-1-(4-chlorophenylmethyl )-indol-2-yl)-2,2-dimethylpropionaldehyde oxime-O-2 acetic acid; 3-(3-(1,1-dimethylethylthio)-5-(quinolin-2-ylmethoxy)-1-(4-chloro-phenylmethyl) indol-2-yl)-2,2-dimethylpropionaldehyde oxime-O-2-(3-methyl)butyric acid; 3-(3-(1,1-dimethylethylthio)-5-(6,7-dichloroquinolin-2-ylmethoxy)-1-(4-chlorophenylmethyl)indol-2-yl)-2,2-dimethylpropionaldehyde oxime-O-2-acetic acid; and 3-(3-(1,1-dimethylethylthio)-5-(6-fluoroquinolin-2-ylmethoxy)-1-(4chlorophenylmethyl) indol-2-yl)-2,2-dimethylpropionaldehyde oxime-O-2-propionic acid; or a pharmaceutically acceptable salt or ester thereof. See U.S. Pat. No. 5,459,150, incorporated by reference herein.

The compound can be represented by the formula:

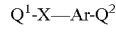

or pharmaceutically acceptable salts thereof, wherein Q is a 9-, 10- or 11-membered bicyclic heterocyclic moiety containing one or two nitrogen heteroatoms and optionally containing a further heteroatom selected from nitrogen, oxygen and sulphur, and Q may optionally bear up to four substituents selected from halogeno, hydroxy, cyano, formyl, oxo, thioxo, (1-4C)alkyl, (3-4C)alkenyl, (3-4C)alkynyl, (1-4C)alkoxy, fluoro-(1-4C)alkyl, hydroxy-(1-4C)alkyl, (2-5C)alkanoyl, phenyl, benzoyl and benzyl, and wherein said phenyl, benzoyl and benzyl substituents may optionally bear one or two substituents selected from halogeno, (1-4C)alkyl and (1-4C) alkoxy;

X is oxy, thio, sulphinyl or sulphonyl; Ar is phenylene, pyridinediyl, pyrimidinediyl, thiophenediyl, furandiyl, thiazolediyl, oxazolediyl, thiadiazolediyl or oxadiazolediyl which may optionally bear one or two substituents selected from halogeno, cyano, trifluoromethyl, hydroxy, amino, (1-4C)alkyl, (1-4C)alkoxy, (1-4C)alkylamino and di-(1-4C)alkylamino; and Q is selected from the groups of the formulae II and III:

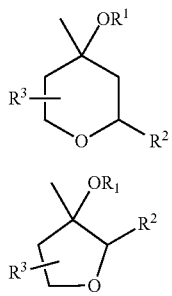

wherein R is hydrogen, (2-5C)alkanoyl or benzoyl, and wherein said benzoyl group may optionally bear one or two substituents selected from halogeno, (1-4C)alkyl and (1-4C) alkoxy; R is (1-4C)alkyl; and R is hydrogen or (1-4C)alkyl; or R and R are linked to form a methylene, vinylene, ethylene or trimethylene group. Preferably, the compound is selected from the group consisting of: (2S,4R)-4-[5-fluoro-3-(1-methyl-2-oxo-1,2,3,4-tetrahydroquinolin-6-ylthio)phenyl]-4-hydroxy-2-ethyltetrahydropyran, (2S,4R)-4-[5-fluoro-3-(1-methyl-2-oxo-1,2,3,4-tetrahydroquinolin-6-ylsulphonyl) phenyl]-4-hydroxy-2-methyltetrahydropyran, (2S,4R)-4-hydroxy-2-methyl-4-[2-(1-methyl-2-oxo-1,2,3,4-tetrahydroquinolin-6-ylthio)thiazol-5-yl]tetrahydropyran, (2S,4R)-4-hydroxy-2-methyl-4-[2-(1-methyl-2-oxo-1,2,3,4-tetrahydroquinolin-6-ylsulphonyl)thiazol-5-yl]tetrahydropyran, (2S,4R)-4-[2-(7-fluoro-1-methyl-2-oxo-1,2,3,4-tetrahydroquinolin-6-ylthio)thiazol-5-yl]-4-hydroxy-2-methyltetrahydropyran, (2S,4R)-4-hydroxy-2-methyl-4-[2-(1-methyl-2-oxoindolin-5-ylthio)thiazol-5-yl]tetrahydropyran, (2S,4R)-4-hydroxy-2-methyl-4-[2-(1-methyl-2-oxo-1,2,3,4-tetrahydroquinolin-6-ylthio)thien-4-yl]tetrahydropyran, (2S,4R)-4-hydroxy-2-methyl-4-[2-(1-methyl-2-oxo-1,2,3,4-tetrahydroquinolin-6-ylsulphonyl) thien-4-yl]tetrahydropyran, (2S,4R)-4-hydroxy-2-methyl-4-[2-(1-methyl-2-oxo-1,2,3,4-tetrahydroquinolin-6-ylthio) thien-5-yl]tetrahydropyran, (2S,4R)-4-hydroxy-2-methyl-4-[2-(1-methyl-2-oxo-1,2-dihydroquinolin-6-ylthio)thien-4-yl]tetrahydropyran, (2S,4R)-4-hydroxy-2-methyl-4-[2-(1,8-dimethyl-2-oxo-1,2,3,4-tetrahydroquinolin-6-ylthio)thien-4-yl]tetrahydropyran, 4-[2-(8-fluoro-1-methyl-2-oxo-1,2,3,4-tetrahydroquinolin-6-ylthio)thien-4-yl]-4-hydroxy-2-methyltetrahydropyran, 4-[2-(7-fluoro-1-methyl-2-oxo-1,2,3,4-tetrahydroquinolin-6-ylthio)thien-4-yl]-4-hydroxy-2-methyltetrahydropyran, (2S,4R)-4-hydroxy-2-methyl-4-[2-(1-methyl-2-oxoindolin-5-ylthio)thien-4-yl] tetrahydropyran, (2S,4R)-4-hydroxy-2-methyl-4-[3-(1-methyl-2-oxo-1,2,3,4-tetrahydroquinolin-6-ylthio)phenyl] tetrahydropyran, (2S,4R)-4-hydroxy-2-methyl-4-[3-(1-methyl-2-oxo-1,2,3,4-tetrahydroquinolin-6-ylsulphonyl) phenyl]tetrahydropyran, (2S,4R)-4-[3-(1-ethyl-2-oxo-1,2,3,4-tetrahydroquinolin-6-ylthio)phenyl]-4-hydroxy-2-methyltetrahydropyran, (2S,4R)-4-[3-(7-fluoro-1-methyl-2-oxo-1,2,3,4-tetrahydroquinolin-6-ylthio)phenyl]-4-hydroxy-2-methyltetrahydropyran, (2S,4R)-4-hydroxy-2-methyl-4-[3-(1-methyl-2-oxo-1,2-dihydroquinolin-6-ylthio) phenyl]tetrahydropyran, (2S,4R)-4-[3-(8-chloro-1-methyl-2-oxo-1,2,3,4-tetrahydroquinolin-6-ylthio)phenyl]-4-hydroxy-2-methyltetrahydropyran and (2S,4R)-4-hydroxy-2-methyl-4-[3-(1-methyl-2-oxoindolin-5-ylthio)phenyl] tetrahydropyran. See EP 623614 B1, incorporated herein by reference.

The compound can be represented by the formula:

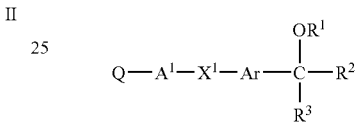

wherein Q is a 10-membered bicyclic heterocyclic moiety containing one or two nitrogen heteroatoms which bears one or two thioxo substituents, and which heterocyclic moiety may optionally bear one, two or three further substituents selected from halogeno, hydroxy, cyano, amino, (1-4C)alkyl, (1-4C)alkoxy, fluoro-(1-4C)alkyl, (1-4C)alkylamino, di-[(1-4C)alkyl]amino, amino-(1-4C)alkyl, (1-4C)alkylamino-(1-4C)alkyl, di-[(1-4C)alkyl]amino-(1-4C)alkyl, phenyl and phenyl-(1-4C)alkyl, and wherein said phenyl or phenyl-(1-4C)alkyl substituent may optionally bear a substituent selected from halogeno, (1-4C)alkyl and (1-4C)alkoxy; wherein A is a direct link to X or is (1-3C)alkylene; wherein X is oxy, thio, sulphinyl, sulphonyl or imino; wherein Ar is phenylene which may optionally bear one or two substituents selected from halogeno, hydroxy, amino, nitro, cyano, carbamoyl, ureido, (1-4C)alkyl, (1-4C)alkoxy, (1-4C)alkylamino, di-[(1-4C)alkyl]amino, fluoro-(1-4C)alkyl and (2-4C)alkanoylamino; or Ar is pyridylene; wherein R is (1-4C)alkyl, (3-4C)alkenyl or (3-4C)alkynyl; and wherein R and R together form a group of the formula -A-X-A- which, together with the carbon atom to which A and A are attached, defines a ring having 5 to 7 ring atoms, wherein A and A, which may be the same or different, each is (1-3C)alkylene and X is oxy, thio, sulphinyl or sulphonyl, and which ring may bear one, two or three substituents, which may be the same or different, selected from hydroxy, (1-4C)alkyl and (1-4C) alkoxy; or wherein R and R together form a group of the formula -A-X-A- which, together with the oxygen atom to which A is attached and with the carbon atom to which A is attached, defines a ring having 5 to 7 ring atoms, wherein A and A, which may be the same or different, each is (1-3C) alkylene and X is oxy, thio, sulphinyl or sulphonyl, and which ring may bear one, two or three (1-4C)alkyl substituents, and wherein R is (1-4C)alkyl, (2-4C)alkenyl or (2-4C)alkynyl; or a pharmaceutically-acceptable salt thereof. Preferably, the compound is selected from the group consisting of: 4-(5-fluoro-3-(1-methyl-2-thioxo-1,2-dihydroquinolin-6-ylmethoxy)phenyl]-4-ethoxytetrahydropyran and 4-(5-fluoro- 3-(1-methyl-2-thioxo-1,2,3,4-tetrahydroquinolin-6-lmethoxy)phenyl]-4-methoxytetrahydropyran, 4-(5-fluoro-3-(1-methyl-2-thioxo-1,2,3,4-tetrahydroquinolin-6-ylthio)phenyl]-4-methoxytetrahydropyran and pharmaceutically-acceptable salt thereof. See EP 466452 B1, incorporated herein by reference.

The compound can be a substituted 4-(quinolin-2-61-methoxy)phenylacetic acid derivative represented by the following formula:

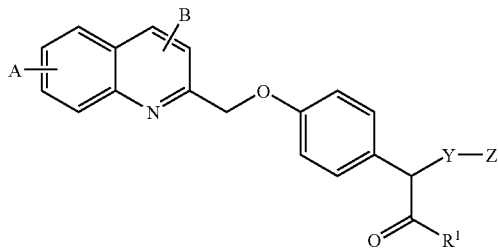

or pharmaceutically acceptable salt thereof, wherein $R^1$ represents a group of the formula:

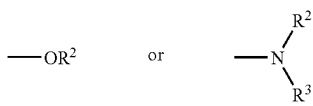

$R^2$ and $R^3$ are identical or different and represent hydrogen, lower alkyl, phenyl, benzyl or a group of the formula:

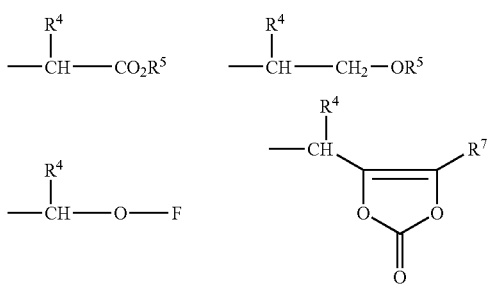

$R^4$ represents hydrogen, lower alkyl, phenyl or benzyl, which can optionally be substituted by hydroxyl, carboxyl, lower alkoxycarbonyl, lower alkylthio, heteroaryl or carbamoyl, $R^5$ represents hydrogen, lower alkyl, phenyl or benzyl, $R^6$ represents a group of the formula —$COR^5$ or —$CO^2 R^5$, $R^7$ represents hydrogen, lower alkyl or phenyl, Y represents a group of the formula:

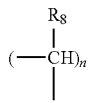

wherein $R^8$ represents hydrogen, lower alkyl or phenyl and n denotes a number of 0 to 5, Z represents norbornyl, or represents a group of the formula:

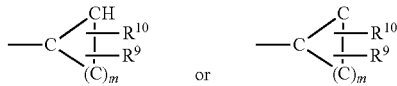

wherein $R^9$ and $R^{10}$ are identical or different and denote hydrogen, lower alkyl or phenyl, or $R^9$ and $R^{10}$ can together form a saturated carbocyclic ring having up to 6 carbon atoms and m denotes a number from 1 to 6, and A and B are identical or different and denote hydrogen, lower alkyl or halogen, or a pharmaceutically acceptable salt thereof. Preferably the compounds are selected from the group consisting of: 2-[4-(quinolin-2-yl-methoxy)phenyl]-2-cyclopentylacetic acid, 2-[4-(quinolin-2-yl-methoxy)phenyl]-2-cyclohexylacetic acid, and 2-[4-(quinolin-2-yl-methoxy)phenyl]-2-cycloheptylacetic acid, (+)-enantiomer of 2-[4-(quinolin-2-yl-methoxy)phenyl]-2-cyclopentylacetic acid, (−)-enantiomer of 2-[4-(quinolin-2-yl-methoxy)phenyl]-2-cyclopentylacetic acid and pharmaceutically acceptable salts thereof. See U.S. Pat. No. 4,970,215, incorporated herein by reference.

The compound can be represented by the formula:

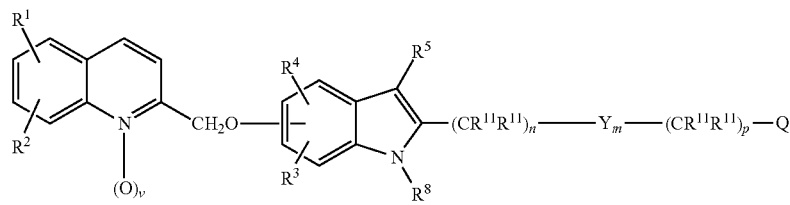

wherein R, R, R, R and R are independently hydrogen, halogen, lower alkyl, lower alkenyl, lower alkynyl, —CF3, —CN, —NO2, —N3, —C(OH)RR, —CO2R, —SR, —S(O)R, —S(O)2R, —S(O)2NRR,—OR,—NRR, —C(O)R or —(CH2)tR; R is hydrogen, —CH3, —CF3, —C(O)H, X—R or X—R; R and R are independently: alkyl, —(CH2)uPh(R)2 or —(CH2)uTh(R)2; R is —CF3 or R; R is hydrogen or X—R; each R is independently hydrogen or lower alkyl, or two R's on same carbon atom are joined to form a cycloalkyl ring of 3 to 6 carbon atoms; R is hydrogen, lower alkyl or —CH2R; R is lower alkyl or —(CH2)rR; R is —CF3 or R; R is hydrogen, —C(O)R, R, or two R's on the same nitrogen may be joined to form a monocyclic heterocyclic ring of 4 to 6 atoms containing up to 2 heteroatoms chosen from O, S or N; R is hydrogen, —CF3, lower alkyl, lower alkenyl, lower alkynyl or —(CH2)rR; R is —(CH2)s-C(RR)—(CH2)s-R or —CH2C(O)NRR; R is hydrogen or lower alkyl; R is a) a monocyclic or bicyclic heterocyclic ring containing from 3 to 9 nuclear carbon atoms and 1 or 2 nuclear hetero-atoms selected from N, S or O and with each ring in the heterocyclic radical being formed of 5 or 6 atoms, or b) the radical W—R; R is alkyl or C(O)R; R is phenyl substituted with 1 or 2 R groups; R is hydrogen, halogen, lower alxyl, lower alkoxy, lower alkylthio, lower alkylsulfonyl, lower alkylcarbonyl, —CF3, —CN, —NO2 or —N3; R is alkyl, cycloalkyl, monocyclic mono-heterocyclic ring;

R is the residual structure of a standard amino acid, or R and R attached to the same N can cyclize to form a proline residue; m is 0 to 1; n is 0 to 3; p is 1 to 3 when m is 1; p is 0 to 3 when m is 0; r is 0 to 2; s is 0 to 3; t is 0 to 2; u is 0 to 3; v is 0 or 1; W is 0, S or NR; X is 0, or NR; X is C(O), CRR, S, S(O) or S(O)2; X is C(O), CRR, S(O)2 or a bond; Y is X or X; Q is —CO2R, —C(O)NHS(O)2R, —NHS(O)2R, —S(O)2NHR —C(O)NRR, —CO2R, —C(O)NRR, —CH2OH, or 1H- or 2H-tetrazol-5-yl;

and the pharmaceutically acceptable salts thereof Preferred embodiments of the compounds are selected from the following and pharmaceutically acceptable salts thereof:

3-[N-(p-chlorobenzyl)-3-(t-butylthio)-5-(quinolin-2-ylmethoxy)indol-2-yl]-2,2-dimethylpropanoic acid;

3-[N-(p-chlorobenzyl)-3-methyl-5-(quinolin-2-ylmethoxy)indol-2-yl]-2,2-dimethylpropanoic acid;

3-[N-(p-t-butylthiobenzyl)-3-(t-butylthio)-5-(quinolin-2-ylmethoxy)indol-2-yl]-2,2-dimethylpropanoic acid;

3-[N-(p-chlorobenzyl)-3-(phenylthio)-5-(quinolin-2-ylmethoxy)indol-2-yl]-2,2-dimethylpropanoic acid;

3-[N-(p-chlorobenzyl)-3-(phenylsulfonyl)-5-(quinolin-2-ylmethoxy)indol-2-yl]-2,2-dimethyl propanoic acid, N-oxide;

3-[N-(p-chlorobenzyl)-3-(phenylsulfonyl)-5-(quinolin-2-ylmethoxy)indol-2-yl]-2,2-dimethylpropanoic acid;

3-[N-(p-chlorobenzyl)-3-(phenylsulfinyl)-5-(quinolin-2-ylmethoxy)indol-2-yl]-2,2-dimethylpropanoic acid;

3-[N-(p-chlorobenzyl)-5-(quinolin-2-ylmethoxy)indol-2-yl]-2,2-dimethylpropanoic acid;

3-[N-(p-chlorobenzyl)-3-benzoyl-5-(quinolin2-ylmethoxy)indol-2-yl]-2,2-dimethylpropanoic acid;

3-[N-(p-chlorobenzyl)-3-benzyl-5-(quinolin-2-ylmethoxy)indol-2-yl]-2,2-dimethylpropanoic acid;

3-[N-(p-chlorobenzyl)-3-(3,3-dimethyl-1-oxo-1-butyl)-5-(quinolin-2-ylmethoxy)indol-2-yl]-2,2-dimethylpropanoic acid;

2-[N-(p-chlorobenzyl)-3-(t-butylthio)-5-(quinolin-2-ylmethoxy)indol-2-yl]ethoxyethanoic acid;

3-[N-(p-chlorobenzyl)-3-(3,3-dimethyl-1-butyl)-5-(quinolin-2-ylmethoxy)indol-2-yl]-2,2-dimethylpropanoic acid;

3-[N-(p-chlorobenzyl)-3-(t-butylthio)-5-(quinolin-2-ylmethoxy)indol-2-yl]-2-methylpropanoic acid;

3-[N-(p-chlorobenzyl)-3-methyl-5-(6,7-dichloroquinolin-2-ylmethoxy)indol-2-yl]-2,2-dimethylpropanoic acid;

3-[N-(p-chlorobenzyl)-3-methyl-5-(7-chloroquinolin-2-ylmethoxy)indol-2-yl]-2,2-dimethylpropanoic acid;

3-[N-(p-chlorobenzyl)-4-allyl-5-(quinolin-2-ylmethoxy)-3-(t-butylthio)indol-2-yl]-2,2-dimethylpropanoic acid;

3-[N-(p-chlorobenzyl)-4-allyl-5-(quinolin-2-ylmethoxy)indol-2-yl]-2,2-dimethylpropanoic acid;

3-[N-(p-chlorobenzyl)-6-(quinolin-2-ylmethoxy)-3-(t-butylthio)indol-2-yl]-2,2-dimethylpropanoic acid;

3-[N-(p-chlorobenzyl)-4-(quinolin-2-ylmethoxy)-3-(t-butylthio)indol-2-yl]-2,2-dimethylpropanoic acid;

3-[N-(p-chlorobenzyl)-7-(quinolin-2-ylmethoxy)-3-(t-butylthio)indol-2-yl]-2,2-dimethylpropanoic acid;

2-[2-[N-(p-chlorobenzyl)-3-(t-butylthio)-5-(quinolin-2-ylmethoxy)indol-2-yl]ethoxy]propanoic acid;

3-[N-(p-chlorobenzyl)-4-(quinolin-2-ylmethoxy)indol-2-yl]-2,2-dimethylpropanoic acid;

3-[N-methyl-3-(p-chlorobenzoyl)-6-(quinolin-2-ylmethoxy)indol-2-yl]-2,2-dimethylpropanoic acid, 3-[N-methyl-3-(p-chlorobenzyl)-6-(quinolin-2-ylmethoxy)indol-2-yl]-2,2-dimethylpropanoic acid, 3-[N-(4-chlorobenzyl)-3-i-propoxy-5-(quinolin-2-ylmethoxy)indol-2-yl]-2,2-dimethylpropanoic acid, 3-[N-(4-chlorobenzyl)-3-(t-butylthio)-5-(quinolin-2-ylmethoxy)indol-2-yl]-2-ethylpropanoic acid, 3-[N-(4-chlorobenzyl)-3-trifluoroacetyl-5-(quinolin-2-ylmethoxy)indol-2-yl]-2,2-dimethylpropanoic acid, 3-[N-(4-chlorobenzyl)-3-(3,3-dimethyl-1-oxo-1-butyl)-5-(quinolin-2-ylmethoxy)indol-2-yl]-2-methylpropanoic acid, 3-[3-(3,3-dimethyl-1-oxo-1-butyl-5-(quinolin-2-ylmethoxy)indol-2-yl]-2,2-dimethylpropanoic acid, 3-[N-(4-triflouromethylbenzyl)-3-(3,3-dimethyl-1-oxo-1-butyl)-5-(quinolin-2-yl-methoxy)indol-2-yl]-2,2-dimethylpropanoic acid, 3-[N-benzyl-3-(3,3-dimethyl-1-oxo-1-butyl)-5-(quinolin-2-ylmethoxy)indol-2-yl]-2,2-dimethylpropanoic acid, 3-[N-(3-methoxybenzyl)-3-(3,3-dimethyl-1-oxo-1-butyl)-5-(quinolin-2-ylmethoxy)indol-2-yl]-2,2-dimethylpropanoic acid, 3-[N-allyl-3-(3,3-dimethyl-1-oxo-1-butyl)-5-(quinolin-2-ylmethoxy)indol-2-yl]-2,2-dimethylpropanoic acid, 3-[N-(4-methoxybenzyl)-3-(3,3-dimethyl-1-oxo-1-butyl)-5-(quinolin-2-ylmethoxy)indol-2-yl]-2,2-dimethylpropanoic acid, 3-[N-methyl-3-(3,3-dimethyl-1-oxo-3-butyl)-5-(quinolin-2-ylmethoxy)indol-2-yl]-2,2-dimethylpropanoic acid, 3-[3-(4-chlorobenzyl)-6-(quinolin-2-ylmethoxy)indol-2-yl]-2,2-dimethylpropanoic acid.

3-[N-(phenylsulfonyl)-3-(4-chlorobenzyl)-6-(quinolin-2-ylmethoxy)indol-2-yl]-2,2-dimethylpropanoic acid, 3-[N-benzyl-3-(4-chlorobenzyl)-6-(quinolin-2-ylmethoxy)indol-2-yl]-2,2-dimethylpropanoic acid, 3-[N-(4-chlorobenzyl)-3-(t-butylsulfonyl)-5-(quinolin-2-ylmethoxy)indol-2-yl]-2,2-dimethylpropanoic acid, 3-[N-(4-chlorobenzyl)-3-(t-butylsulfinyl)-5-(quinolin-2-ylmethoxy)indol-2-yl]-2,2-dimethylpropanoic acid, 3-[N-allyl-3-(4-chlorobenzyl)-6-(quinolin-2-ylmethoxy)indol-2-yl]-2,2-dimethylpropanoic acid, 3-[N-(n-propyl)-3-(4-chlorobenzyl)-6-(quinoline-2-ylmethoxy)indol-2-yl]-2,2-dimethylpropanoic acid, 3-[N-ethyl-3-(4-chlorobenzyl)-6-(quinolin-2-ylmethoxy)indol-2-yl]-2,2-dimethylpropanoic acid, 3-[N-(4-chlorobenzyl)-3-(4-t-butylbenzoyl)-5-(quinolin-2-yl-methoxy)indol-2-y]-2,2-dimethylpropanoic acid, 3-[N-(4-chlorobenzyl)-3-(4-chlorobenzoyl)-5-(quinolin-2-ylmethoxy)indol-2-yl]-2,2-dimiethylpropanoic acid, 3-[N-(4-chlorobenzyl)-3-(1,1-dimethylethyl)-5-(quinolin-2-ylmethoxy)indol-2-yl]-2,2-dimethylpropanoic acid, 3-[N-(4-chlorobenzyl)-3-acetyl-5-(quinolin-2-ylmethoxy)indol-2-yl]-2,2-dimethylpropanoic acid 3-[N-(4-chlorobenzyl)-3-cyclopropanecarbonyl-5-(quinolin-2-ylmethoxy)indol-2-yl]-2,2-dimethylpropanoic acid, 3-[N-(4-chlorobenzyl)-3-(3-cyclopentylpropanoyl)-5-(quinolin-2-ylmethoxy)indol-2-yl]-2,2-dimethylpropanoic acid, 3-[N-(4-chlorobenzyl)-3-(3-methylbutanoyl)-5-(quinolin-2-yl-methoxy)indol-2-yl]-2,2-dimethylpropanoic acid, 3-[N-(4-chlorobenzyl)-3-propanoyl-5-(quinolin-2-ylmethoxy)indol-2-yl]-2,2-dimethylpropanoic acid, 3-[N-(4-chlorobenzyl)-3-(2-methylpropanoyl)-5-(quinolin-2-ylmethoxy)indol-2-yl]-2,2-dimethylpropanoic acid, 3-[N-(4-chlorobenzyl)-3-trimethylacetyl-5-(quinolin-2-ylmethoxy)indol-2-yl]-2,2-dimethylpropanoic acid, 3-[N-(4-chlorobenzyl)-3-phenylacetyl-5-(quinolin-2-yl-methoxy)indol-2-yl]-2,2-dimethylpropanoic acid,
3-[N-(4-fluorobenzyl)-3-(3,3-dimethyl-1-oxo-1-butyl)-5-(quinolin-2-ylmethoxy)indol-2-yl]-2,2-dimethylpropanoic acid,
3-[N-(4-bromobenzyl)-3-(3,3-dimethyl-1-oxo-1-butyl)-5-(quinolin-2-ylmethoxy)indol-2-yl]-2,2-dimethylpropanoic acid,
3-[N-(4-iodobenzyl)-3-(3,3-dimethyl-1-oxo-l -butyl)-5-(quinolin-2-ylmethoxy)indol-2-yl]-2,2-dimethylpropanoic acid,
3-[N-(4-chlorobenzyl)-3-(1,1-dimethylbutyl)-5-(quinolin-2-ylmethoxy)indol-2-yl]-2,2-dimethylpropanoic acid,
3-[N-(4-chlorobenzyl)-3-(1,1-dimethylpropyl)-5-(quinolin-2-ylmethoxy)indol-2-yl]-2,2-dimethylpropanoic acid,
3-[N-(3-fluorobenzyl)-3-(1,1-dimethylethyl)-5-(quinolin-2-ylmethoxy)indol-2-yl]-2,2-dimethylpropanoic acid,
3-[N-(4-chlorobenzyl)-3-(3-methylethyl)-5-(quinolin-2-yl-methoxy)indol-2-yl]-2,2-dimethylpropanoic acid,
3-[N-(4-chlorobenzyl)-3-cyclopropyl-5-(quinolin-2-yl-methoxy)indol-2-yl]-2,2-dimethylpropanoic acid,
3-[N-(4-chlorobenzyl)-3-(1-methyl-1-cyclopropyl)-5-(quinolin-2-ylmethoxy)indol-2-yl]-2,2-dimethylpropanoic acid,
3-[N-(4-chlorobenzyl)-3-cyclopentyl-5-(quinolin-2-yl-methoxy)indol-2-yl]-2,2-dimethylpropanoic acid,
3-[N-(4-chlorobenzyl)-3-cyclohexyl-5-(quinolin-2-yl-methoxy)indol-2-yl]-2,2-dimethylpropanoic acid,
3-[N-(4-chlorobenzyl)-3-(alpha-, alpha-dimethylbenzyl)-5-(quinolin-2-ylmethoxy)indol-2-yl]-2,2-dimethylpropanoic acid,
3-[N-(4-chlorobenzyl)-3-(2-{4-chloro-alpha, alpha-dimethylbenzyl}-5-(quinolin-2-ylmethoxy)indol-2-yl]-2,2-dimethylpropanoic acid,
3-[N-(4-chlorobenzyl)-3-(1-adamantyl)-5-(quinolin-2-yl-methoxy)indol-2-yl]-2,2-dimethylpropanoic acid,
3-[N-(4-chlorobenzyl)-3-((1-adamantyl)methyl)-5-(quinolin-2-ylmethoxy)indol-2-yl]-2,2-dimethylpropanoic acid,
3-[N-(1,1-dimethylethyl)-3-(4-chlorobenzyl)-6-(quinolin-2-ylmethoxy)indol-2-yl]-2,2-dimethylpropanoic acid,
3-[N-(1,1-dimethylpropyl)-3-(4-chlorobenzyl)-6-(quinoline-2-ylmethoxy)indol-2-yl]-2,2-dimethylpropanoic acid,
3-[N-(4-chlorobenzyl)-3-(3,3-dimethyl-1-oxo-1-butyl)-5-(quinolin-2-ylmethoxy)indol-2-yl]-2,2-diethylpropanoic acid,
methyl 3-[N-(4-chlorobenzyl)-3,6-bis(acetyl)-5-(quinolin-2-ylmethoxy)indol-2-yl]-2,2 dimethyl propanoate or
methyl 3-[N-(4-chlorobenzyl)-3,6-bis(cyclopropanecarbonyl)-5-(quinolin-2-ylmethoxy)indol-2-yl]-2,2-dimethyl propanoate. See EP 419049 B1, incorporated herein by reference.

The term "alkyl" refers to a monovalent group derived from a straight or branched chain saturated hydrocarbon by the removal of a single hydrogen atom. Alkyl groups are exemplified by methyl, ethyl, n- and iso-propyl, n-, sec-, iso- and tert-butyl, and the like. The term "hydroxyalkyl" represents an alkyl group, as defined above, substituted by one to three hydroxyl groups with the proviso that no more than one hydroxy group may be attached to a single carbon atom of the alkyl group. The term "alkylamino" refers to a group having the structure —NHR' wherein R' is alkyl, as previously defined, examples of alkylamino include methylamino, ethylamino, iso-propylamino and the like. The term "alkylaminocarbonyl" refers to an alkylamino group, as previously defined, attached to the parent molecular moiety through a carbonyl group. Examples of alkylaminocarbonyl include methylamino-carbonyl, ethylaminocarbonyl, iso-propylaminocarbonyl and the like. The term "alkylthio" refers to an alkyl group, as defined above, attached to the parent molecular moiety through a sulfur atom and includes such examples as methylthio, ethylthio, propylthio, n-, sec- and tert-butylthio and the like. The term "alkanoyl" represents an alkyl group, as defined above, attached to the parent molecular moiety through a carbonyl group. Alkanoyl groups are exemplified by formyl, acetyl, propionyl, butanoyl and the like. The term "alkanoylamino" refers to an alkanoyl group, as previously defined, attached to the parent molecular moiety through a nitrogen atom. Examples of alkanoylamino include formamido, acetamido, and the like. The term "N-alkanoyl-N-alkylamino" refers to an alkanoyl group, as previously defined, attached to the parent molecular moiety through an aminoalkyl group. Examples of N-alkanoyl-N-alkylamino include N-methylformamido, N-methyl-acetamido, and the like. The terms "alkoxy" or "alkoxyl" denote an alkyl group, as defined above, attached to the parent molecular moiety through an oxygen atom. Representative alkoxy groups include methoxyl, ethoxyl, propoxyl, butoxyl, and the like. The term "alkoxyalkoxyl" refers to an alkyl group, as defined above, attached through an oxygen to an alkyl group, as defined above, attached in turn through an oxygen to the parent molecular moiety. Examples of alkoxyalkoxyl include methoxymethoxyl, methoxyethyoxyl, ethoxyethoxyl and the like. The term "alkoxyalkyl" refers to an alkoxy group, as defined above, attached through an alkylene group to the parent molecular moiety. The term "alkoxycarbonyl" represents an ester group; i.e., an alkoxy group, attached to the parent molecular moiety through a carbonyl group such as methoxycarbonyl, ethoxycarbonyl, and the like. The term "alkenyl" denotes a monovalent group derived from a hydrocarbon containing at least one carbon-carbon double bond by the removal of a single hydrogen atom. Alkenyl groups include, for example, ethenyl, propenyl, butenyl, 1-methyl-2-buten-1-yl and the like. The term "alkylene" denotes a divalent group derived from a straight or branched chain saturated hydrocarbon by the removal of two hydrogen atoms, for example methylene, 1,2-ethylene, 1,1-ethylene, 1,3-propylene, 2,2-dimethylpropylene, and the like. The term "alkenylene" denotes a divalent group derived from a straight or branched chain hydrocarbon containing at least one carbon-carbon double bond. Examples of alkenylene include —CH=CH—, —CH$_2$CH=CH—, —C(CH$_3$)=CH—, —CH$_2$CH=CHCH$_2$—, and the like. The term "cycloalkylene" refers to a divalent group derived from a saturated carbocyclic hydrocarbon by the removal of two hydrogen atoms, for example cyclopentylene, cyclohexylene, and the like. The term "cycloalkyl" denotes a monovalent group derived from a monocyclic or bicyclic saturated carbocyclic ring compound by the removal of a single hydrogen atom. Examples include cyclopropyl, cyclobutyl, cyclopentyl, cyclohexyl, bicyclo[2.2.1]heptanyl, and bicyclo[2.2.2]octanyl. The term "alkynylene" refers to a divalent group derived by the removal of two hydrogen atoms from a straight or branched chain acyclic hydrocarbon group containing a carbon-carbon triple bond. Examples of alkynylene include —CH≡CH—, —CH≡CH—CH$_2$—, —CH≡CH—CH (CH$_3$)—, and the like. The term "carbocyclic aryl" denotes a monovalent carbocyclic ring group derived by the removal of a single hydrogen atom from a monocyclic or bicyclic fused or non-fused ring system obeying the "4n+2 p electron" or Huckel aromaticity rule. Examples of carbocyclic aryl groups include phenyl, 1- and 2-naphthyl, biphenylyl, fluorenyl, and the like. The term "(carbocyclic aryl)alkyl" refers to a carbocyclic aryl ring group as defined above, attached to the parent molecular moiety through an alkylene group. Representative (carbocyclic aryl)alkyl groups include phenylmethyl, phenylethyl, phenylpropyl, 1-naphthylmethyl, and the like. The term "carbocyclicarylalkoxy" refers to a carbocyclicaryl alkyl group, as defined above, attached to the parent molecular moiety through an oxygen atom. The term "carbocyclic aryloxyalkyl" refers to a carbocyclic aryl group, as defined above, attached to the parent molecular moiety through an oxygen atom and thence through an alkylene group. Such groups are exemplified by phenoxymethyl, 1- and 2-naphthyloxymethyl, phenoxyethyl and the like. The term "(carbocyclic aryl)alkoxyalkyl" denotes a carbocyclic aryl group as defined above, attached to the parent molecular moiety through an alkoxyalkyl group. Representative (carbocyclic aryl)alkoxyalkyl groups include phenylmethoxymethyl, phenylethoxymethyl, 1- and 2-naphthylmethoxyethyl, and the like. "Carbocyclic arylthioalkyl" represents a carbocyclic aryl group as defined above, attached to the parent molecular moiety through a sulfur atom and thence through an alklyene group and are typified by phenylthiomethyl, 1- and 2-naphthylthioethyl and the like. The term "dialkylamino" refers to a group having the structure —NR'R" wherein R' and R" are independently selected from alkyl, as previously defined. Additionally, R' and R" taken together may optionally be —(CH$_2$)$_{kk}$— where kk is an integer of from 2 to 6. Examples of dialkylamino include, dimethylamino, diethylaminocarbonyl, methylethylamino, piperidino, and the like. The term "halo or halogen" denotes fluorine, chlorine, bromine or iodine. The term "haloalkyl" denotes an alkyl group, as defined above, having one, two, or three halogen atoms attached thereto and is exemplified by such groups as chloromethyl, bromoethyl, trifluoromethyl, and the like. The term "hydroxyalkyl" represents an alkyl group, as defined above, substituted by one to three hydroxyl groups with the proviso that no more than one hydroxy group may be attached to a single carbon atom of the alkyl group. The term "phenoxy" refers to a phenyl group attached to the parent molecular moiety through an oxygen atom. The term "phenylthio" refers to a phenyl group attached to the parent molecular moiety through a sulfur atom. The term "pyridyloxy" refers to a pyridyl group attached to the parent molecular moiety through an oxygen atom. The terms "heteroaryl" or "heterocyclic aryl" as used herein refers to substituted or unsubstituted 5- or 6-membered ring aromatic groups containing one oxygen atom, one, two, three, or four nitrogen atoms, one nitrogen and one sulfur atom, or one nitrogen and one oxygen atom. The term heteroaryl also includes bi-or tricyclic groups in which the aromatic heterocyclic ring is fused to one or two benzene rings. Representative heteroaryl groups are pyridyl, thienyl, indolyl, pyrazinyl, isoquinolyl, pyrrolyl, pyrimidyl, benzothienyl, furyl, benzo[b]furyl, imidazolyl, thiazolyl, carbazolyl, and the like. The term "heteroarylalkyl" denotes a heteroaryl group, as defined above, attached to the parent molecular moiety through an alkylene group. The term "heteroaryloxy" denotes a heteroaryl group, as defined above, attached to the parent molecular moiety through an oxygen atom. The term "heteroarylalkoxy" denotes a heteroarylalkyl group, as defined above, attached to the parent molecular moiety through an oxygen atom.

Method of Reducing Risk Factors for Cardiovascular Disease

The present invention encompasses compositions and methods for reducing risk factors for MI, ACS, stroke, and/or PAOD. The method of reducing risk factors comprise administering a composition comprising a leukotriene synthesis inhibitor, described in detail herein alone, or in combination with a statin, to an individuals at risk for any of these conditions. Individuals at risk include the target population described herein, especially individuals with elevated CRP, and those at risk for other diseases and conditions associated with FLAP and/or other members of the leukotriene pathway. In particular, the invention encompasses methods of reducing plasma CRP levels or plasma serum amyloid A levels comprising administering an effective amount of leukotriene inhibitor alone or in combination with a statin.

Statins are competitive inhibitors of 3-hydroxy-3-methyl-glutarlcoenzyme A (HMG-CoA) reductase, the enzyme that converts HMG-CoA to the cholesterol precursor mevalonic acid. Upon binding to the active site of HMG-CoA reducatase, statins alter the conformation of the enzyme, thereby preventing it from attaining a functional structure. The conformational change of the HMG-CoA reducatase active site makes statin drugs very effective and specific. Inhibition of HMG-CoA reducatase reduces intracellular cholesterol synthesis in hepatocytes. The reduction of intracellular cholesterol results in an increase in hepatic LDL receptors on the cell surface, which in turn reduces the level of circulating LDL and its precursors, intermediate density lipoproteins (IDL) and very low density lipoproteins (VLDL). In addition, statins inhibit hepatic synthesis of apolipoprotein B-100, which results in a decrease in the synthesis and secretion of triglyercide rich lipoproteins. Additional beneficial effects of statins on lipid biosynthesis include inhibition of LDL oxidation, and inhibition of the expression of scavenger receptors. Statins also reduce the accumulation of esterified cholersterol into macrophages, increase endothelial cell nitric oxide synthesis, reduce inflammatory processes, increase the stability of artherosclerotic plaques, and restore platelet activity and the coagulation process.

Because of their beneficial effects and high specificity, statins have become some of the most prescribed medicines in the Western industrialized world. In preferred embodiments of the invention, the statin is one of the following agents: rovuvastatin, fluvastatin, atorvastatin, lovastatin, simvastatin, pravastatin or pitavastatin. These agents are described in detail in the Statin Agent Table III below.

AGENT TABLE III

| Resigeeter to | Approved St Marketed as | Stain Name | Chemical | Structure | Patent No | Patent Expiration | (Infor from PDR) Dosages (tablet sizes) |
|---|---|---|---|---|---|---|---|
| AstraZeneca | CRESTOR | ROVUVASTATIN | bis[(E)-7-[4-(4-fluorophenyl)-6-isopropyl-2-[methyl(methylsulfonyl)amino]pyrimidin-5-yl](3R, 5S)-3,5-dihydroxyhept-6-enoic acid]calcium salt | 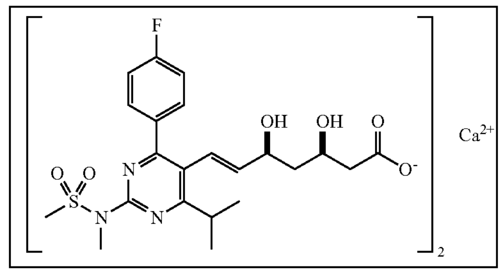 | 6316460<br>6589959<br>RE37314 | Aug. 04, 2020<br>Dec. 23, 2019<br>Jun. 12, 2012 | 5 mg, 10 mg, 20 mg and 40 mg |
| Novartis | LESCOL | FLUVASTATIN | [R*, S*-(E)]-(±)-7-[3-(4-fluorophenyl)-1-(1-methylethyl)-1H-indol-2-yl]-3,5-dihydroxy-6-heptenoic acid, monosodium salt | 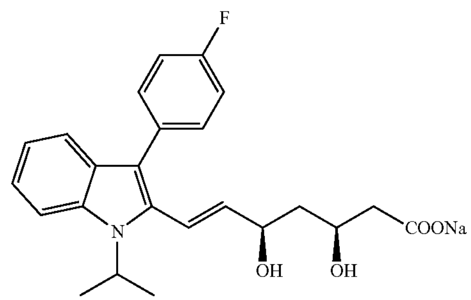 | 5354772<br>5354772<br>5356896 | Oct. 11, 2011<br>Oct. 11, 2011<br>Dec. 12, 2011 | EQ 20 mg and EQ 40 mg |
| Pfizer | LIPITOR | ATORVASTATIN | [R-(R*, R*)]-2-(4-fluorophenyl)-(beta),[dgr]-dihydroxy-5-(1-methylethyl)-3-phenyl-4-[(phenylamino)carbonyl]-1H-pyrrole-1-heptanoic acid, calcium salt (2:1)trihydrate | 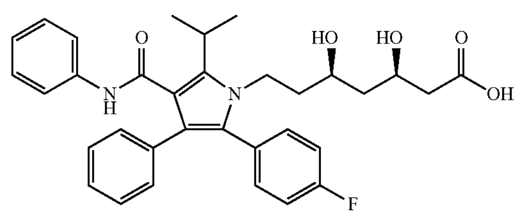 | 4681893<br>4681893*PED<br>5273995<br>5273995*PED<br>5685104<br>5686104*PED<br>5969156<br>5969156*PED<br>6126971<br>6126971*PED | Sep. 24, 2009<br>Mar. 24, 2010<br>Dec. 28, 2010<br>Jun. 28, 2011<br>Nov. 11, 2014<br>May 11, 2015<br>Jul. 08, 2016<br>Jan. 08, 2017<br>Jan. 19, 2013<br>Jul. 19, 2013 | EQ 10 mg, EQ 20 mg, EQ 40 mg and EQ 40 mg |

AGENT TABLE III-continued

| Resigeeter to | Approved St Marketed as | Stain Name | Chemical | Structure | Patent No | Patent Expiration | (Infor from PDR) Dosages (tablet sizes) |
|---|---|---|---|---|---|---|---|
| MERCK | MEVACOR | LOVASTATIN | [1S-[1(alpha)(R*), 3(alpha), 7(beta), 8(beta)(2S*, 4S*), 8a(beta)]]-1,2,3,7,8,8a-hexahydro-3,7-dimethyl-8-[2-(tetrahydro-4-hydroxy-6-oxo-2H-pyran-2-yl)ethyl]-1-naphthalenyl 2-methylbutanoate | 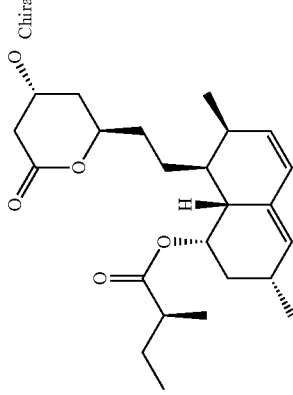 | There are no unexpired patents for this product in the Orange Book Database. | | 10 mg, 20 mg and 40 mg |
| MERCK | ZOCOR | SIMVASTATIN | butanoic acid, 2,2-dimethyl-,1,2,3,7,8,8a-hexahydro-3,7-dimethyl-8-[2-(tetrahydro-4-hydroxy-6-oxo-2H-pyran-2-yl)-ethyl]-1-naphthalenyl ester, [1S-[1(alpha), 3(alpha), 7(beta), 8(beta)(2S*, 4S*), 8a(beta)]]- | 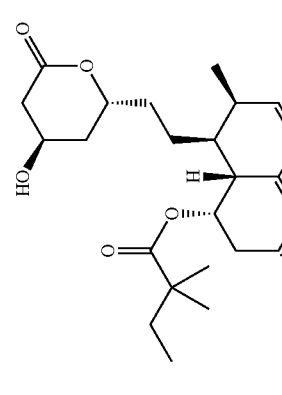 | 4444784<br>4444784*PED | Dec. 23, 2005<br>Jun. 23, 2006 | 5 mg, 10 mg, 20 mg, 40 mg and 80 mg |
| BMS | PRAVACOL | PRAVASTATIN | 1-Naphthalene-heptanoic acid, 1,2,6,7,8,8a-hexahydro-(beta), (delta), 6-trihydroxy-2-methyl-8-(2-methyl-1-oxobutoxy)-, monosodium salt, [1S-[1(alpha)(betaS*, (delta)S*), 2(alpha), 6(alpha), 8(beta)(R*), 8a(alpha)]]- | 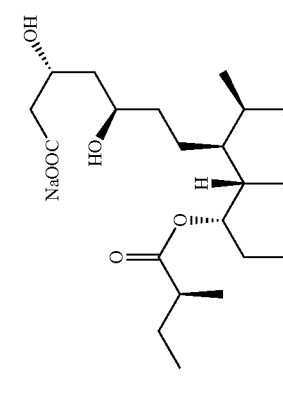 | 4346227<br>4346227*PED<br>5035447<br>5030447*PED<br>5180589<br>5180589*PED<br>5622985<br>5622985*PED | Oct. 20, 2005<br>Apr. 20, 2006<br>Jul. 09, 2008<br>Jan. 09, 2009<br>Jul. 09, 2008<br>Jan. 09, 2009<br>Apr. 22, 2014<br>Oct. 22, 2014 | 5 mg, 10 mg, 20 mg, 40 mg and 80 mg. |

AGENT TABLE III-continued

| Resigeeter to | Approved St Marketed as | Stain Name | Chemical | Structure | Patent No | Patent Expiration | (Infor from PDR) Dosages (tablet sizes) |
|---|---|---|---|---|---|---|---|
| | Livalo | Pitavastatin | AutoNom Name: (E)-(3R, 5S)-7-[2-Cyclopropyl-4-(4-fluoro-phenyl)-quinolin-3-yl]-3,5-di-hydroxy-hept-6-enoic acid | | | | |

Mevastatin and related compounds are disclosed in U.S. Pat. No. 3,983,140. Lovastatin (mevinolin) and related compounds are disclosed in U.S. Pat. No. 4,231,938. Keto analogs of mevinolin (lovastatin) are disclosed in European Patent Application No. 0,142,146 A2, and quinoline and pyridine derivatives are disclosed in U.S. Pat. Nos. 5,506,219 and 5,691,322.

Pravastatin and related compounds are disclosed in U.S. Pat. No. 4,346,227. Simvastatin and related compounds are disclosed in U.S. Pat. Nos. 4,448,784 and 4,450,171.

Fluvastatin and related compounds are disclosed in U.S. Pat. No. 5,354,772. Cerivastatin and related compounds are disclosed in U.S. Pat. Nos. 5,006,530 and 5,177,080. Atorvastatin and related compounds are disclosed in U.S. Pat. Nos. 4,681,893; 5,273,995; 5,385,929 and 5,686,104.

Pitavastatin (nisvastatin (NK-104) or itavastatin) and related compounds are disclosed in U.S. Pat. No. 5,011,930. Rosuvastatin (visastatin (ZD-4522)) and related compounds are disclosed in U.S. Pat. No. 5,260,440.

Other possible HMG CoA reductase molecules are described in U.S. Pat. Nos. 5,753,675; 4,613,610; 4,686,237; 4,647,576; and 4,499,289; and British patent no. GB 2205837.

The patents cited in relation to statins or other agents identified herein describe how to make and use the statins/agents, as well as biochemically active homologs thereof, salts, prodrugs, metabolites, and the like. Such patents are incorporated herein by reference in their entirety. Dosings for the statins also have been described in patent and trade literature (e.g., Physician's Desk Reference 2004, incorporated herein by reference) and by the manufacturers and clinical practitioners that prescribe them. Combination therapy using statin dosings similar to what is used when prescribing statins alone, or less, is specifically contemplated.

Compositions comprising a leukotriene synthesis inhibitor alone or in combination with a statin may comprises a leukotriene synthesis inhibitor in an amount effective to reduce a risk factor such as CRP or serum amyloid A. Effective daily doses of the leukotriene synthesis inhibitors are between 0.01 mg and 100 g, more preferably 0.1 mg to 1 g, and all individual doses within these ranges are specifically contemplated. Exemplary single adult doses include 10 mg, 25 mg, 50 mg, 75 mg, 100 mg, 150 mg, 200 mg, 250 mg, 300 mg, 350 mg, 400 mg, 500 mg and 750 mg, from one to four times daily. The compositions may comprise a statin in an amount effective to reduce total serum cholesterol, serum LDL, and/or serum CRP. Effective daily doses are between 0.01 mg and 100 g, more preferably 0.1 mg to 1 g, and all individual doses within these ranges are specifically contemplated. Exemplary individual doses include 5 mg, 10 mg, 15mg, 20 mg, 30 mg, 40 mg 50 mg, 60 mg, and 80 mg, 100 mg, 150 mg, 200 mg, 250 mg, and 500 mg, from one to four times daily.

Emerging evidence suggests that elevated CRP is an independent risk factor for adverse clinical outcomes. See, e.g., Ridker et al., N. Engl. J. Med. 352: 1 (Jan. 6, 2005). In another variation, the invention provides compositions, unit doses, and methods of treatment where a leukotriene synthesis inhibitor and a statin are included or administered in amounts that synergistically act to reduce serum CRP levels. Synergistically effective amounts are amounts that either (a) achieve a greater percentage reduction in CRP than is achieved in an average patient using either type of agent alone, at a safe and effective amount, or (b) reduces CRP a comparable amount to single agent therapy, with fewer side effects; or (c) reduces CRP a comparable amount to single agent therapy, and also reduces at least one other cardiovascular risk factor more effectively than single agent therapy alone.

In one variation, the invention provides a composition comprising a leukotriene synthesis inhibitor and a statin for simultaneous administration, e.g., in one dose. A composition in tablet, pill, or capsule form, including sustained release formulations, are specifically contemplated. In another variation, a unit dose comprising a single dose of the leukotriene synthesis inhibitor and a single dose of the statin, packaged together but not in admixture, is contemplated. In another variation, methods of the invention involve administering a composition comprising a leukotriene inhibitor and a composition comprising a statin at the same or different times, e.g., administering the leukotriene synthesis inhibitor before or after administration of a composition comprising a statin. Compositions for and methods of administering the agents to an individual continuously (e.g., through a patch or i.v.), one to twelve times a day, once a day, every other day, twice a week, weekly, or monthly for one or more weeks, months, or years, or for the entire life of a patient, depending on the level of risk for the individual, is specifically contemplated, to manage serum CRP and other cardiovascular risk factor levels. It is contemplated that these compositions will be used for treatment and lifestyle management plans for primary or secondary MI, ACS, stroke, or PAOD prevention.

Nucleic Acid Therapeutic Agents

In another embodiment, a nucleic acid of the invention; a nucleic acid complementary to a nucleic acid of the invention; or a portion of such a nucleic acid (e.g., an oligonucleotide as described below); or a nucleic acid encoding a member of the leukotriene pathway (e.g., 5-LO), can be used in "antisense" therapy, in which a nucleic acid (e.g., an oligonucleotide) which specifically hybridizes to the mRNA and/or genomic DNA of a nucleic acid is administered or generated in situ. The antisense nucleic acid that specifically hybridizes to the mRNA and/or DNA inhibits expression of the polypeptide encoded by that mRNA and/or DNA, e.g., by inhibiting translation and/or transcription. Binding of the antisense nucleic acid can be by conventional base pair complementarity, or, for example, in the case of binding to DNA duplexes, through specific interaction in the major groove of the double helix.

An antisense construct can be delivered, for example, as an expression plasmid as described above. When the plasmid is transcribed in the cell, it produces RNA that is complementary to a portion of the mRNA and/or DNA that encodes the polypeptide for the member of the leukotriene pathway (e.g., FLAP or 5-LO). Alternatively, the antisense construct can be an oligonucleotide probe that is generated ex vivo and introduced into cells; it then inhibits expression by hybridizing with the mRNA and/or genomic DNA of the polypeptide. In one embodiment, the oligonucleotide probes are modified oligonucleotides that are resistant to endogenous nucleases, e.g., exonucleases and/or endonucleases, thereby rendering them stable in vivo. Exemplary nucleic acid molecules for use as antisense oligonucleotides are phosphoramidate, phosphothioate and methylphosphonate analogs of DNA (see also U.S. Pat. Nos. 5,176,996, 5,264,564 and 5,256,775). Additionally, general approaches to constructing oligomers useful in antisense therapy are also described, for example, by Van der Krol et al. (*Biotechniques* 6:958-976 (1988)); and Stein et al. (*Cancer Res.* 48:2659-2668 (1988)). With respect to antisense DNA, oligodeoxyribonucleotides derived from the translation initiation site are preferred.

To perform antisense therapy, oligonucleotides (mRNA, cDNA or DNA) are designed that are complementary to mRNA encoding the polypeptide. The antisense oligonucleotides bind to mRNA transcripts and prevent translation. Absolute complementarity, although preferred, is not required. A sequence "complementary" to a portion of an RNA, as referred to herein, indicates that a sequence has sufficient complementarity to be able to hybridize with the RNA, forming a stable duplex; in the case of double-stranded antisense nucleic acids, a single strand of the duplex DNA may thus be tested, or triplex formation may be assayed. The ability to hybridize will depend on both the degree of complementarity and the length of the antisense nucleic acid, as described in detail above. Generally, the longer the hybridizing nucleic acid, the more base mismatches with an RNA it may contain and still form a stable duplex (or triplex, as the case may be). One skilled in the art can ascertain a tolerable degree of mismatch by use of standard procedures.

The oligonucleotides used in antisense therapy can be DNA, RNA, or chimeric mixtures or derivatives or modified versions thereof, single-stranded or double-stranded. The oligonucleotides can be modified at the base moiety, sugar moiety, or phosphate backbone, for example, to improve stability of the molecule, hybridization, etc. The oligonucleotides can include other appended groups such as peptides (e.g. for targeting host cell receptors in vivo), or agents facilitating transport across the cell membrane (see, e.g., Letsinger et al., *Proc. Natl. Acad. Sci. USA* 86:6553-6556 (1989); Lemaitre et al., *Proc. Natl. Acad. Sci. USA* 84:648-652 (1987); PCT International Publication No. WO 88/09810) or the blood-brain barrier (see, e.g., PCT International Publication No. WO 89/10134), or hybridization-triggered cleavage agents (see, e.g., Krol et al., *BioTechniques* 6:958-976 (1988)) or intercalating agents. (See, e.g., Zon, Pharm. Res. 5: 539-549 (1988)). To this end, the oligonucleotide may be conjugated to another molecule (e.g., a peptide, hybridization triggered cross-linking agent, transport agent, hybridization-triggered cleavage agent).

The antisense molecules are delivered to cells that express the member of the leukotriene pathway in vivo. A number of methods can be used for delivering antisense DNA or RNA to cells; e.g., antisense molecules can be injected directly into the tissue site, or modified antisense molecules, designed to target the desired cells (e.g., antisense linked to peptides or antibodies that specifically bind receptors or antigens expressed on the target cell surface) can be administered systematically. Alternatively, in a preferred embodiment, a recombinant DNA construct is utilized in which the antisense oligonucleotide is placed under the control of a strong promoter (e.g., pol III or pol II). The use of such a construct to transfect target cells in the patient results in the transcription of sufficient amounts of single stranded RNAs that will form complementary base pairs with the endogenous transcripts and thereby prevent translation of the mRNA. For example, a vector can be introduced in vivo such that it is taken up by a cell and directs the transcription of an antisense RNA. Such a vector can remain episomal or become chromosomally integrated, as long as it can be transcribed to produce the desired antisense RNA. Such vectors can be constructed by recombinant DNA technology methods standard in the art and described above. For example, a plasmid, cosmid, YAC or viral vector can be used to prepare the recombinant DNA construct that can be introduced directly into the tissue site. Alternatively, viral vectors can be used which selectively infect the desired tissue, in which case administration may be accomplished by another route (e.g., systemically).

In another embodiment of the invention, small double-stranded interfering RNA (RNA interference (RNAi)) can be used. RNAi is a post-transcription process, in which double-stranded RNA is introduced, and sequence-specific gene silencing results, though catalytic degradation of the targeted mRNA. See, e.g., Elbashir, S. M. et al., *Nature* 411:494-498 (2001); Lee, N. S., *Nature Biotech.* 19:500-505 (2002); Lee, S-K. et al., *Nature Medicine* 8(7):681-686 (2002); the entire teachings of these references are incorporated herein by reference. RNAi is used routinely to investigate gene function in a high throughput fashion or to modulate gene expression in human diseases (Chi et al., *PNAS*, 100 (11):6343-6346 (2003)). Introduction of long double standed RNA leads to sequence-specific degradation of homologous gene transcripts. The long double stranded RNA is metabolized to small 21-23 nucleotide siRNA (small interfering RNA). The siRNA then binds to protein complex RISC (RNA-induced silencing complex) with dual function helicase. The helicase has RNAas activity and is able to unwind the RNA. The unwound si RNA allows an antisense strand to bind to a target. This results in sequence dependent degradation of cognate mRNA. Aside from endogenous RNAi, exogenous RNAi, chemically synthesized or recombinantly produced can also be used. Using non-intronic portions of the FLAP gene, such as corresponding mRNA portions of SEQ ID NO: 1, or portions of SEQ ID NO: 3, target regions of the FLAP gene that are accessible for RNAi are targeted and silenced. With this technique it is possible to conduct a RNAi gene walk of the nucleic acids of the FLAP gene and determine the amount of inhibition of the protein product. Thus it is possible to design gene-specific therapeutics by directly targeting the mRNAs of the gene.

Endogenous expression of a member of the leukotriene pathway (e.g., FLAP, 5-LO) can also be reduced by inactivating or "knocking out" the gene or its promoter using targeted homologous recombination (e.g., see Smithies et al., *Nature* 317:230-234 (1985); Thomas & Capecchi, *Cell* 51:503-512 (1987); Thompson et al., *Cell* 5:313-321 (1989)). For example, an altered, non-functional gene of a member of the leukotriene pathway (or a completely unrelated DNA sequence) flanked by DNA homologous to the endogenous gene (either the coding regions or regulatory regions of the gene) can be used, with or without a selectable marker and/or a negative selectable marker, to transfect cells that express the gene in vivo. Insertion of the DNA construct, via targeted homologous recombination, results in inactivation of the gene. The recombinant DNA constructs can be directly administered or targeted to the required site in vivo using appropriate vectors, as described above. Alternatively, expression of non-altered genes can be increased using a similar method: targeted homologous recombination can be used to insert a DNA construct comprising a non-altered functional gene, or the complement thereof, or a portion thereof, in place of a gene in the cell, as described above. In another embodiment, targeted homologous recombination can be used to insert a DNA construct comprising a nucleic acid that encodes a polypeptide variant that differs from that present in the cell.

Alternatively, endogenous expression of a member of the leukotriene pathway can be reduced by targeting deoxyribonucleotide sequences complementary to the regulatory region of the member of the leukotriene pathway (i.e., the promoter and/or enhancers) to form triple helical structures that prevent transcription of the gene in target cells in the body. (See generally, Helene, C., *Anticancer Drug Des.*, 6(6):569-84 (1991); Helene, C. et al., *Ann. N.Y Acad. Sci.* 660:27-36 (1992); and Maher, L. J., *Bioassays* 14(12):807-15 (1992)).

Likewise, the antisense constructs described herein, by antagonizing the normal biological activity of one of the members of the leukotriene pathway, can be used in the manipulation of tissue, e.g., tissue differentiation, both in vivo and for ex vivo tissue cultures. Furthermore, the antisense techniques (e.g., microinjection of antisense molecules, or transfection with plasmids whose transcripts are anti-sense with regard to a nucleic acid RNA or nucleic acid sequence) can be used to investigate the role of one or more members of the leukotriene pathway in the development of disease-related conditions. Such techniques can be utilized in cell culture, but can also be used in the creation of transgenic animals.

The therapeutic agents as described herein can be delivered in a composition, as described above, or by themselves. They can be administered systemically, or can be targeted to a particular tissue. The therapeutic agents can be produced by a variety of means, including chemical synthesis; recombinant production; in vivo production (e.g., a transgenic animal, such as U.S. Pat. No. 4,873,316 to Meade et al.), for example, and can be isolated using standard means such as those described herein. In addition, a combination of any of the above methods of treatment (e.g., administration of non-altered polypeptide in conjunction with antisense therapy targeting altered mRNA for a member of the leukotriene pathway; administration of a first splicing variant in conjunction with antisense therapy targeting a second splicing variant) can also be used.

The invention additionally pertains to use of such therapeutic agents, as described herein, for the manufacture of a medicament for the treatment of MI, ACS, stroke, PAOD and/or atherosclerosis, e.g., using the methods described herein.

Monitoring Progress of Treatment

The current invention also pertains to methods of monitoring the response of an individual, such as an individual in one of the target populations described above, to treatment with a leukotriene synthesis inhibitor.

Because the level of inflammatory markers can be elevated in individuals who are in the target populations described above, an assessment of the level of inflammatory markers of the individual both before, and during, treatment with the leukotriene synthesis inhibitor will indicate whether the treatment has successfully decreased production of leukotrienes in the arterial vessel wall or in bone-marrow derived inflammatory cells. For example, in one embodiment of the invention, an individual who is a member of a target population as described above (e.g., an individual at risk for MI, ACS, stroke or PAOD, such as an individual who is at-risk due to a FLAP haplotype) can be assessed for response to treatment with a leukotriene synthesis inhibitor, by examining leukotriene levels or leukotriene. metabolite levels in the individual. Blood, serum, plasma or urinary leukotrienes (e.g., leukotriene E4, cysteinyl leukotriene 1), or ex vivo production of leukotrienes (e.g., in blood samples stimulated with a calcium ionophore to produce leukotrienes), or leukotriene metabolites, can be measured before, and during or after treatment with the leukotriene synthesis inhibitor. The leukotriene or leukotriene metabolite level before treatment is compared with the leukotriene or leukotriene metabolite level during or after treatment. The efficacy of treatment is indicated by a decrease in leukotriene production: a level of leukotriene or leukotriene metabolite during or after treatment that is significantly lower than the level of leukotriene or leukotriene metabolite before treatment, is indicative of efficacy. A level that is lower during or after treatment can be shown, for example, by decreased serum or urinary leukotrienes, or decreased ex vivo production of leukotrienes, or decreased leukotriene, metabolites. A level that is "significantly lower", as used herein, is a level that is less than the amount that is typically found in control individual(s), or is less in a comparison of disease risk in a population associated with the other bands of measurement (e.g., the mean or median, the highest quartile or the highest quintile) compared to lower bands of measurement (e.g., the mean or median, the other quartiles; the other quintiles).

For example, in one embodiment of the invention, the level of a leukotriene or leukotriene metabolite is assessed in an individual before treatment with a leukotriene synthesis inhibitor; and during or after treatment with the leukotriene synthesis inhibitor, and the levels are compared. A level of the leukotriene or leukotriene metabolite during or after treatment that is significantly lower than the level of the leukotriene or leukotriene metabolite before treatment, is indicative of efficacy of treatment with the leukotriene synthesis inhibitor. In another embodiment, production of a leukotriene or a leukotriene metabolite is stimulated in a first test sample from the individual, using a calcium ionophore, before treatment with a leukotriene synthesis inhibitor, and is also stimulated in a second test sample from the individual, using a calcium ionophore, during or after treatment with the leukotriene synthesis inhibitor, and the level of production in the first test sample is compared with with the level of production of the leukotriene or leukotriene metabolite in the second test sample. A level of the leukotriene or leukotriene metabolite in the second test sample that is significantly lower than the level of the leukotriene or leukotriene metabolite in the first test sample, is indicative of efficacy of treatment with the leukotriene synthesis inhibitor.

In another embodiment of the invention, an individual who is a member of a target population of individuals at risk for MI, ACS, stroke or PAOD (e.g., an individual in a target population described above, such as an individual at-risk due to elevated C-reactive protein) can be assessed for response to treatment with a leukotriene synthesis inhibitor, by examining levels of inflammatory markers in the individual. For example, levels of an inflammatory marker in an appropriate test sample (e.g., serum, plasma or urine) can be measured before, and during or after treatment with the leukotriene synthesis inhibitor. The level of the inflammatory marker before treatment is compared with the level of the inflammatory marker during or after treatment. The efficacy of treatment is indicated by a decrease in the level of the inflammatory marker, that is, a level of the inflammatory marker during or after treatment that is significantly lower (e.g., significantly lower), than the level of inflammatory marker before treatment, is indicative of efficacy. Representative inflammatory markers include: C-reactive protein (CRP), serum amyloid A, fibrinogen, serum sCD40L, a leukotriene (e.g., LTB4, LTC4, LTD4, LTE4), a leukotriene metabolite, interleukin-6, tissue necrosis factor-alpha, soluble vascular cell adhesion molecules (sVCAM), soluble intervascular adhesion molecules (sICAM), E-selectin, matrix metalloprotease type-1, matrix metalloprotease type-2, matrix metalloprotease type-3, matrix metalloprotease type-9, myeloperoxidase (MPO), and N-tyrosine. In a preferred embodiment, the marker is CRP, sCD40L or MPO.

The efficacy of treatment of a leukotriene synthesis inhibitor may be monitored by measuring at-risk biomarkers in plasma, serum or urine. Clinical assays are available for the following biomarkers: CRP, serum amyloid A, IL-1β, IL-6, IL-8, IL-10, TNF-α, sCD40L, E-selectin, P-selectin and intracellular adhesion molecule-1, vascular cell ashesion molecule-1. The relative risk of a cardiovascular event predicted by CRP levels is low risk has less thatn 1 mg/L, average is 1.0-3.0 mg/L and high risk patients have greater than 3.0 mg/L. Thus, optimal therapeutic effect of a leukotriene synthesis inhibitor alone or in combination with a statin is reducing CRP level to 2.0 mg/L or lower.

The efficacy of treatment of a statin is monitored by measuring the level of total serum cholesterol, serum LDL and/or serum triglycerides. A level of serum total cholesterol, LDL-C and/or triglycerides during or after treatment, which is significantly lower than the level of total cholesterol, LDL-C and/or triglycerides before treatment is indicative of the efficacy of the treatment. For cholesterol management purposes, "high risk patients" have an LDL level of 130 mg/Dl or higher and optimally the statin treatment will reduce the LDL level to less than 100 mg/dL. "Moderately-high risk patients" are those individuals with two or more risk factors for coronary heart disease with a 10-20% risk of heart attack within ten years. Optimally, the statin treatment will keep the LDL level under 129 mg/dL. More recent studies show an additional benefit on morbidity and mortality when statin therapy decreased serum LDL-C to less than 70 mg/dL. (Ridker et al., *N. Engl. J. Med.* 352(1): 20-28, 2005; Nissen et al., *N. Engl. J. Med.* 352(1): 29-38, 2005). Thus optimal therapeutic effect of a statin would be to lower LDL-C levels to under 70 mg/dL. as described by Ridker et al., *N. Engl. J. Med.* 352(1): 20-28, 2005 and Nissen et al., *N. Engl. J. Med.* 352(1): 29-38, 2005, statin therapy may reduce CRP. CRP is an additional parameter that may be monitored in connection with statin therapy.

Assessment of Increased Risk

The present invention additionally pertains to methods for assessing an individual (e.g., an individual who is in a target population as described herein, such as an individual who is at risk for MI, ACS, stroke or PAOD), for an increased risk of MI, ACS, atherosclerosis, stroke, transient ischemic attack, transient monocular blindness, asymptomatic carotid stenosis, PAOD, claudication, or limb ischemia. The methods comprise assessing the level of a leukotriene metabolite (e.g., LTE4, LTD4, LTB4) in the individual, wherein an increased level of leukotriene metabolite is indicative of an increased risk. The level can be measured in any appropriate tissue or fluid sample, such as blood, serum, plasma, or urine. In one particular embodiment, the sample comprises neutrophils. The level of the leukotriene metabolite can be measured by standard methods, such as the methods described herein. For example, in one embodiment, production of a leukotriene metabolite is stimulated in a first test sample from the individual, using a calcium ionophore. The level of production is compared with a control level. The control level is a level that is typically found in control individual(s), such as individual who are not at risk for MI, ACS, stroke or PAOD; alternatively, a control level is the level that is found by comparison of disease risk in a population associated with the lowest band of measurement (e.g., below the mean or median, the lowest quartile or the lowest quintile) compared to higher bands of measurement (e.g., above the mean or median, the second, third or fourth quartile; the second, third, fourth or fifth quintile). A level of production of the leukotriene metabolite that is significantly greater than the control level, is indicative of an increased risk. Individuals at increased risk are candidates for treatments described herein.

Pharmaceutical Compositions

The present invention also pertains to pharmaceutical compositions comprising agents described herein, for example, an agent that is a leukotriene synthesis inhibitor as described herein. For instance, a leukotriene synthesis inhibitor can be formulated with a physiologically acceptable carrier or excipient to prepare a pharmaceutical composition. The carrier and composition can be sterile. The formulation should suit the mode of administration.

The invention also provides for compositions comprising a leukotriene synthesis inhibit, as set out in Agent Table I, and a statin, as set out in the Agent Table III. The leukotriene synthesis inhibitor and the statin may be coformulated with a physiological acceptable carrier or expedient to prepare a pharmaceutical composition. This composition may be formulation to deliver the leukotriene synthesis inhibitor and statin in a single dose. The processes for the isolation and purification of statins and other HMG-CoA reductase inhibitors include different combinations of extraction, chromatography, lactonization and crystallization methods. Examples of formulations for statins, statin derivatives and statin salts are found in the following, all incorporated by reference in their entirety, U.S. Pat. Nos. 6,316,460, 6,589,959, RE37, 314, 5,354,772, 5,356,896, 5,686,104, 5,969,156, 6,126,971, 5,030,447, 5,180,589, 5,622,985, 6,825,015, 6,838,566, 5,403,860, 5,763,653, and 5,763,646, International Patent Publications WO 86/03488, WO 86/07054, French Patent No. 2596393, European Patent Application No. 0221025, British Patent Nos. 2055100A and 2073199A and European Patent No. 65,835.

Suitable pharmaceutically acceptable carriers include but are not limited to water, salt solutions (e.g., NaCl), saline, buffered saline, alcohols, glycerol, ethanol, gum arabic, vegetable oils, benzyl alcohols, polyethylene glycols, gelatin, carbohydrates such as lactose, amylose or starch, dextrose, magnesium stearate, talc, silicic acid, viscous paraffin, perfume oil, fatty acid esters, hydroxymethylcellulose, polyvinyl pyrolidone, etc., as well as combinations thereof. The pharmaceutical preparations can, if desired, be mixed with auxiliary agents, e.g., lubricants, preservatives, stabilizers, wetting agents, emulsifiers, salts for influencing osmotic pressure, buffers, coloring, flavoring and/or aromatic substances and the like which do not deleteriously react with the active agents.

The composition, if desired, can also contain minor amounts of wetting or emulsifying agents, or pH buffering agents. The composition can be a liquid solution, suspension, emulsion, tablet, pill, capsule, sustained release formulation, or powder. The composition can be formulated as a suppository, with traditional binders and carriers such as triglycerides. Oral formulation can include standard carriers such as pharmaceutical grades of mannitol, lactose, starch, magnesium stearate, polyvinyl pyrollidone, sodium saccharine, cellulose, magnesium carbonate, etc.

Methods of introduction of these compositions include, but are not limited to, intradermal, intramuscular, intraperitoneal, intraocular, intravenous, subcutaneous, topical, oral and intranasal. Other suitable methods of introduction can also include gene therapy (as described below), rechargeable or biodegradable devices, particle acceleration devices ("gene guns") and slow release polymeric devices. The pharmaceutical compositions of this invention can also be administered as part of a combinatorial therapy with other agents.

The composition can be formulated in accordance with the routine procedures as a pharmaceutical composition adapted for administration to human beings. For example, compositions for intravenous administration typically are solutions in sterile isotonic aqueous buffer. Where necessary, the composition may also include a solubilizing agent and a local anesthetic to ease pain at the site of the injection. Generally, the ingredients are supplied either separately or mixed together in unit dosage form, for example, as a dry lyophilized powder or water free concentrate in a hermetically sealed container such as an ampule or sachette indicating the quantity of active agent. Where the composition is to be administered by infusion, it can be dispensed with an infusion bottle containing sterile pharmaceutical grade water, saline or dextrose/water. Where the composition is administered by injection, an ampule of sterile water for injection or saline can be provided so that the ingredients may be mixed prior to administration.

For topical application, nonsprayable forms, viscous to semi-solid or solid forms comprising a carrier compatible with topical application and having a dynamic viscosity preferably greater than water, can be employed. Suitable formulations include but are not limited to solutions, suspensions, emulsions, creams, ointments, powders, enemas, lotions, sols, liniments, salves, aerosols, etc., which are, if desired, sterilized or mixed with auxiliary agents, e.g., preservatives, stabilizers, wetting agents, buffers or salts for influencing osmotic pressure, etc. The agent may be incorporated into a cosmetic formulation. For topical application, also suitable are sprayable aerosol preparations wherein the active ingredient, preferably in combination with a solid or liquid inert carrier material, is packaged in a squeeze bottle or in admixture with a pressurized volatile, normally gaseous propellant, e.g., pressurized air.

Agents described herein can be formulated as neutral or salt forms.

Pharmaceutically acceptable salts include those formed with free amino groups such as those derived from hydrochloric, phosphoric, acetic, oxalic, tartaric acids, etc., and those formed with free carboxyl groups such as those derived from sodium, potassium, ammonium, calcium, ferric hydroxides, isopropylamine, triethylamine, 2-ethylamino ethanol, histidine, procaine, etc.

The agents are administered in a therapeutically effective amount. The amount of agents which will be therapeutically effective in the treatment of a particular disorder or condition will depend on the nature of the disorder or condition, and can be determined by standard clinical techniques. In addition, in vitro or in vivo assays may optionally be employed to help identify optimal dosage ranges. The precise dose to be employed in the formulation will also depend on the route of administration, and the seriousness of the symptoms, and should be decided according to the judgment of a practitioner and each patient's circumstances. Effective doses may be extrapolated from dose-response curves derived from in vitro or animal model test systems.

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use of sale for human administration. The pack or kit can be labeled with information regarding mode of administration, sequence of drug administration (e.g., separately, sequentially or concurrently), or the like. The pack or kit may also include means for reminding the patient to take the therapy. The pack or kit can be a single unit dosage of the combination therapy or it can be a plurality of unit dosages. In particular, the agents can be separated, mixed together in any combination, present in a single vial or tablet. For example, a pack or kit of the invention may contain a single dose for delivery of both a leukotriene synthesis inhibitor and a statin concurrently, or contain two or more doses wherein one dose is to deliver a leukotriene synthesis inhibitor and one dose is to deliver a statin either in parallel or one following the other.

Agents assembled in a blister pack or other dispensing means is preferred. For the purpose of this invention, unit dosage is intended to mean a dosage that is dependent on the individual pharmacodynamics of each agent and administered in FDA approved dosages in standard time courses.

Nucleic Acids of the Invention

FLAP Nucleic Acids, Portions and Variants

In addition, the invention pertains to isolated nucleic acid molecules comprising a human FLAP nucleic acid. The term, "FLAP nucleic acid," as used herein, refers to an isolated nucleic acid molecule encoding FLAP polypeptide. The FLAP nucleic acid molecules of the present invention can be RNA, for example, mRNA, or DNA, such as cDNA and genomic DNA. DNA molecules can be double-stranded or single-stranded; single stranded RNA or DNA can be either the coding, or sense strand or the non-coding, or antisense strand. The nucleic acid molecule can include all or a portion of the coding sequence of the gene or nucleic acid and can further comprise additional non-coding sequences such as introns and non-coding 3' and 5' sequences (including regulatory sequences, for example, as well as promoters, transcription enhancement elements, splice donor/acceptor sites, etc.).

For example, a FLAP nucleic acid can consist of SEQ ID NOs: 1 or 3 or the complement thereof, or to a portion or fragment of such an isolated nucleic acid molecule (e.g., cDNA or the nucleic acid) that encodes FLAP polypeptide (e.g., a polypeptide such as SEQ ID NO: 2). In a preferred embodiment, the isolated nucleic acid molecule comprises a nucleic acid molecule selected from the group consisting of SEQ ID NOs: 1 or 3, or their complement thereof.

LTA4H Nucleic Acids, Portions and Variant

In addition, the invention pertains to isolated nucleic acid molecules comprising a human LTA4H nucleic acid. The term, "LTA4H nucleic acid," as used herein, refers to an isolated nucleic acid molecule encoding LTA4H polypeptide. The LTA4H nucleic acid molecules of the present invention can be RNA, for example, mRNA, or DNA, such as cDNA and genomic DNA. DNA molecules can be double-stranded or single-stranded; single stranded RNA or DNA can be either the coding, or sense strand or the non-coding, or antisense strand. The nucleic acid molecule can include all or a portion of the coding sequence of the gene or nucleic acid and can further comprise additional non-coding sequences such as introns and non-coding 3' and 5' sequences (including regulatory sequences, for example, as well as promoters, transcription enhancement elements, splice donor/acceptor sites, etc.).

For example, an LTA4H nucleic acid can consist of SEQ ID NOs: 718 or 719 or the complement thereof, or to a portion or fragment of such an isolated nucleic acid molecule (e.g., cDNA or the nucleic acid) that encodes LTA4H polypeptide (e.g., a polypeptide such as SEQ ID NO: 720). In a preferred embodiment, the isolated nucleic acid molecule comprises a nucleic acid molecule selected from the group consisting of SEQ ID NOs: 718 or 719, or their complement thereof.

Additionally, the nucleic acid molecules of the invention can be fused to a marker sequence, for example, a sequence that encodes a polypeptide to assist in isolation or purification of the polypeptide. Such sequences include, but are not limited to, those that encode a glutathione-S-transferase (GST) fusion protein and those that encode a hemagglutinin A (HA) polypeptide marker from influenza.

An "isolated" nucleic acid molecule, as used herein, is one that is separated from nucleic acids that normally flank the gene or nucleic acid sequence (as in genomic sequences) and/or has been completely or partially purified from other transcribed sequences (e.g., as in an RNA library). For example, an isolated nucleic acid of the invention may be substantially isolated with respect to the complex cellular milieu in which it naturally occurs, or culture medium when produced by recombinant techniques, or chemical precursors or other chemicals when chemically synthesized. In some instances, the isolated material will form part of a composition (for example, a crude extract containing other substances), buffer system or reagent mix. In other circumstances, the material may be purified to essential homogeneity, for example as determined by PAGE or column chromatography such as HPLC. In certain embodiments, an isolated nucleic acid molecule comprises at least about 50, 80 or 90% (on a molar basis) of all macromolecular species present. With regard to genomic DNA, the term "isolated" also can refer to nucleic acid molecules that are separated from the chromosome with which the genomic DNA is naturally associated. For example, the isolated nucleic acid molecule can contain less than about 5 kb, including but not limited to 4 kb, 3 kb, 2 kb, 1 kb, 0.5 kb or 0.1 kb of nucleotides which flank the nucleic acid molecule in the genomic DNA of the cell from which the nucleic acid molecule is derived.

The nucleic acid molecule can be fused to other coding or regulatory sequences and still be considered isolated. Thus, recombinant DNA contained in a vector is included in the definition of "isolated" as used herein. Also, isolated nucleic acid molecules include recombinant DNA molecules in heterologous host cells, as well as partially or substantially purified DNA molecules in solution. "Isolated" nucleic acid molecules also encompass in vivo and in vitro RNA transcripts of the DNA molecules of the present invention. An isolated nucleic acid molecule or nucleic acid sequence can include a nucleic acid molecule or nucleic acid sequence that is synthesized chemically or by recombinant means. Therefore, recombinant DNA contained in a vector is included in the definition of "isolated" as used herein. Also, isolated nucleotide sequences include recombinant DNA molecules in heterologous organisms, as well as partially or substantially purified DNA molecules in solution. In vivo and in vitro RNA transcripts of the DNA molecules of the present invention are also encompassed by "isolated" nucleotide sequences. Such isolated nucleotide sequences are useful in the manufacture of the encoded polypeptide, as probes for isolating homologous sequences (e.g., from other mammalian species), for gene mapping (e.g., by in situ hybridization with chromosomes), or for detecting expression of the nucleic acid in tissue (e.g., human tissue), such as by Northern blot analysis.

The present invention also pertains to nucleic acid molecules which are not necessarily found in nature but which encode a FLAP polypeptide (e.g., a polypeptide having an amino acid sequence comprising an amino acid sequence of SEQ ID NOs: 2), or another splicing variant of a FLAP polypeptide or polymorphic variant thereof. Thus, for example, DNA molecules that comprise a sequence that is different from the naturally occurring nucleic acid sequence but which, due to the degeneracy of the genetic code, encode a FLAP polypeptide of the present invention are also the subjects of this invention. The invention also encompasses nucleotide sequences encoding portions (fragments), or encoding variant polypeptides such as analogues or derivatives of a FLAP polypeptide. Such variants can be naturally occurring, such as in the case of allelic variation or single nucleotide polymorphisms, or non-naturally-occurring, such as those induced by various mutagens and mutagenic processes. Intended variations include, but are not limited to, addition, deletion and substitution of one or more nucleotides that can result in conservative or non-conservative amino acid changes, including additions and deletions. Preferably the nucleotide (and/or resultant amino acid) changes are silent or conserved; that is, they do not alter the characteristics or activity of a FLAP polypeptide. In one preferred embodiment, the nucleotide sequences are fragments that comprise one or more polymorphic microsatellite markers. In another preferred embodiment, the nucleotide sequences are fragments that comprise one or more single nucleotide polymorphisms in a FLAP nucleic acid (e.g., the single nucleotide polymorphisms set forth in Table 13, below).

The present invention also pertains to nucleic acid molecules which are not necessarily found in nature but which encode a LTA4H polypeptide (e.g., a polypeptide having an amino acid sequence comprising an amino acid sequence of SEQ ID NO: 720), or another splicing variant of a LTA4H polypeptide or polymorphic variant thereof. Thus, for example, DNA molecules that comprise a sequence that is different from the naturally occurring nucleic acid sequence but which, due to the degeneracy of the genetic code, encode a LTA4H polypeptide of the present invention are also the subjects of this invention. The invention also encompasses nucleotide sequences encoding portions (fragments), or encoding variant polypeptides such as analogues or derivatives of a LTA4H polypeptide. Such variants can be naturally occurring, such as in the case of allelic variation or single nucleotide polymorphisms, or non-naturally-occurring, such as those induced by various mutagens and mutagenic processes. Intended variations include, but are not limited to, addition, deletion and substitution of one or more nucleotides that can result in conservative or non-conservative amino acid changes, including additions and deletions. Preferably the nucleotide (and/or resultant amino acid) changes are silent or conserved; that is, they do not alter the characteristics or activity of a LTA4H polypeptide. In one preferred embodiment, the nucleotide sequences are fragments that comprise one or more polymorphic microsatellite markers. In another preferred embodiment, the nucleotide sequences are fragments that comprise one or more single nucleotide polymorphisms in a LTA4H nucleic acid (e.g., the single nucleotide polymorphisms set forth in Table 37, below).

Other alterations of the nucleic acid molecules of the invention can include, for example, labeling, methylation, internucleotide modifications such as uncharged linkages (e.g., methyl phosphonates, phosphotriesters, phosphoamidates, carbamates), charged linkages (e.g., phosphorothioates, phosphorodithioates), pendent moieties (e.g., polypeptides), intercalators (e.g., acridine, psoralen), chelators, alkylators, and modified linkages (e.g., alpha anomeric nucleic acids). Also included are synthetic molecules that mimic nucleic acid molecules in the ability to bind to a designated sequence via hydrogen bonding and other chemical interactions. Such molecules include, for example, those in which peptide linkages substitute for phosphate linkages in the backbone of the molecule.

The invention also pertains to nucleic acid molecules that hybridize under high stringency hybridization conditions, such as for selective hybridization, to a nucleic acid sequence described herein (e.g., nucleic acid molecules which specifically hybridize to a nucleic acid sequence encoding polypeptides described herein, and, optionally, have an activity of the polypeptide). In one embodiment, the invention includes variants described herein which hybridize under high stringency hybridization conditions (e.g., for selective hybridization) to a nucleic acid sequence comprising a nucleic acid sequence selected from the group consisting of SEQ ID NOs: 1, 3, 718 and 719 or the complement thereof. In another embodiment, the invention includes variants described herein which hybridize under high stringency hybridization conditions (e.g., for selective hybridization) to a nucleic acid sequence encoding an amino acid sequence of SEQ ID NO: 2, SEQ ID NO: 720 or a polymorphic variant thereof. In a preferred embodiment, the variant that hybridizes under high stringency hybridizations has an activity of a FLAP. In another preferred embodiment, the variant that hybridizes under high stringency hybridizations has an activity of a LTA4H.

Such nucleic acid molecules can be detected and/or isolated by specific hybridization (e.g., under high stringency conditions). "Specific hybridization," as used herein, refers to the ability of a first nucleic acid to hybridize to a second nucleic acid in a manner such that the first nucleic acid does not hybridize to any nucleic acid other than to the second nucleic acid (e.g., when the first nucleic acid has a higher similarity to the second nucleic acid than to any other nucleic acid in a sample wherein the hybridization is to be performed). "Stringency conditions" for hybridization is a term of art which refers to the incubation and wash conditions, e.g., conditions of temperature and buffer concentration, which permit hybridization of a particular nucleic acid to a second nucleic acid; the first nucleic acid may be perfectly (i.e., 100%) complementary to the second, or the first and second may share some degree of complementarity that is less than perfect (e.g., 70%, 75%, 85%, 95%). For example, certain high stringency conditions can be used which distinguish perfectly complementary nucleic acids from those of less complementarity. "High stringency conditions", "moderate stringency conditions" and "low stringency conditions" for nucleic acid hybridizations are explained on pages 2.10.1-2.10.16 and pages 6.3.1-6.3.6 in *Current Protocols in Molecular Biology* (Ausubel, F. M. et al., "*Current Protocols in Molecular Biology*", John Wiley & Sons, (1998), the entire teachings of which are incorporated by reference herein). The exact conditions which determine the stringency of hybridization depend not only on ionic strength (e.g., 0.2×SSC, 0.1×SSC), temperature (e.g., room temperature, 42° C., 68° C.) and the concentration of destabilizing agents such as formamide or denaturing agents such as SDS, but also on factors such as the length of the nucleic acid sequence, base composition, percent mismatch between hybridizing sequences and the frequency of occurrence of subsets of that sequence within other non-identical sequences. Thus, equivalent conditions can be determined by varying one or more of these parameters while maintaining a similar degree of identity or similarity between the two nucleic acid molecules. Typically, conditions are used such that sequences at least about 60%, at least about 70%, at least about 80%, at least about 90% or at least about 95% or more identical to each other remain hybridized to one another. By varying hybridization conditions from a level of stringency at which no hybridization occurs to a level at which hybridization is first observed, conditions which will allow a given sequence to hybridize (e.g., selectively) with the most similar sequences in the sample can be determined.

Exemplary conditions are described in Krause, M. H. and S. A. Aaronson, *Methods in Enzymology* 200: 546-556 (1991), and in, Ausubel, et al., "*Current Protocols in Molecular Biology*", John Wiley & Sons, (1998), which describes the determination of washing conditions for moderate or low stringency conditions. Washing is the step in which conditions are usually set so as to determine a minimum level of complementarity of the hybrids. Generally, starting from the lowest temperature at which only homologous hybridization occurs, each ° C. by which the final wash temperature is reduced (holding SSC concentration constant) allows an increase by 1% in the maximum extent of mismatching among the sequences that hybridize. Generally, doubling the concentration of SSC results in an increase in $T_m$ of –17° C. Using these guidelines, the washing temperature can be determined empirically for high, moderate or low stringency, depending on the level of mismatch sought.

For example, a low stringency wash can comprise washing in a solution containing 0.2×SSC/0.1% SDS for 10 minutes at room temperature; a moderate stringency wash can comprise washing in a prewarmed solution (42° C.) solution containing 0.2×SSC/0.1% SDS for 15 minutes at 42° C.; and a high stringency wash can comprise washing in prewarmed (68° C.) solution containing 0.1×SSC/0.1% SDS for 15 minutes at 68° C. Furthermore, washes can be performed repeatedly or sequentially to obtain a desired result as known in the art. Equivalent conditions can be determined by varying one or more of the parameters given as an example, as known in the art, while maintaining a similar degree of identity or similarity between the target nucleic acid molecule and the primer or probe used.

The percent homology or identity of two nucleotide or amino acid sequences can be determined by aligning the sequences for optimal comparison purposes (e.g., gaps can be introduced in the sequence of a first sequence for optimal alignment). The nucleotides or amino acids at corresponding positions are then compared, and the percent identity between the two sequences is a function of the number of identical positions shared by the sequences (i.e., % identity=# of identical positions/total # of positions×100). When a position in one sequence is occupied by the same nucleotide or amino acid residue as the corresponding position in the other sequence, then the molecules are homologous at that position. As used herein, nucleic acid or amino acid "homology" is equivalent to nucleic acid or amino acid "identity". In certain embodiments, the length of a sequence aligned for comparison purposes is at least 30%, for example, at least 40%, in certain embodiments at least 60%, and in other embodiments at least 70%, 80%, 90% or 95% of the length of the reference sequence. The actual comparison of the two sequences can be accomplished by well-known methods, for example, using a mathematical algorithm. A preferred, non-limiting example of such a mathematical algorithm is described in Karlin et al., *Proc. Natl. Acad. Sci. USA* 90:5873-5877 (1993). Such an algorithm is incorporated into the NBLAST and XBLAST programs (version 2.0) as described in Altschul et al., *Nucleic Acids Res.* 25:389-3402 (1997). When utilizing BLAST and Gapped BLAST programs, the default parameters of the respective programs (e.g., NBLAST) can be used. In one embodiment, parameters for sequence comparison can be set at score=100, wordlength=12, or can be varied (e.g., W=5 or W=20).

Another preferred, non-limiting example of a mathematical algorithm utilized for the comparison of sequences is the algorithm of Myers and Miller, *CABIOS* 4(1): 11-17 (1988). Such an algorithm is incorporated into the ALIGN program (version 2.0) which is part of the GCG sequence alignment software package (Accelrys, Cambridge, UK). When utilizing the ALIGN program for comparing amino acid sequences, a PAM120 weight residue table, a gap length penalty of 12, and a gap penalty of 4 can be used. Additional algorithms for sequence analysis are known in the art and include ADVANCE and ADAM as described in Torellis and Robotti, *Comput. Appl. Biosci.* 10:3-5 (1994); and FASTA described in Pearson and Lipman, *Proc. Natl. Acad. Sci. USA* 85:2444-8 (1988).

In another embodiment, the percent identity between two amino acid sequences can be accomplished using the GAP program in the GCG software package using either a BLOSUM63 matrix or a PAM250 matrix, and a gap weight of 12, 10, 8, 6, or 4 and a length weight of 2, 3, or 4. In yet another embodiment, the percent identity between two nucleic acid sequences can be accomplished using the GAP program in the GCG software package using a gap weight of 50 and a length weight of 3.

The present invention also provides isolated nucleic acid molecules that contain a fragment or portion that hybridizes under highly stringent conditions to a nucleic acid sequence comprising SEQ ID NO: 1 or 3 or the complement of SEQ ID NO: 1 or 3, and also provides isolated nucleic acid molecules that contain a fragment or portion that hybridizes under highly stringent conditions to a nucleic acid sequence encoding an amino acid sequence of the invention or polymorphic variant thereof. The nucleic acid fragments of the invention are at least about 15, for example, at least about 18, 20, 23 or 25 nucleotides, and can be 30, 40, 50, 100, 200 or more nucleotides in length. Longer fragments, for example, 30 or more nucleotides in length, encoding antigenic polypeptides described herein are particularly useful, such as for the generation of antibodies as described below.

Probes and Primers

In a related aspect, the nucleic acid fragments of the invention are used as probes or primers in assays such as those described herein. "Probes" or "primers" are oligonucleotides that hybridize in a base-specific manner to a complementary strand of nucleic acid molecules. Such probes and primers include polypeptide nucleic acids, as described in Nielsen et al., (*Science* 254:1497-1500 (1991)).

A probe or primer comprises a region of nucleic acid that hybridizes to at least about 15, for example about 20-25, and in certain embodiments about 40, 50 or 75, consecutive nucleotides of a nucleic acid of the invention, such as a nucleic acid comprising a contiguous nucleic acid sequence of SEQ ID NOs: 1 or 3 or the complement of SEQ ID Nos: 1 or 3, or a nucleic acid sequence encoding an amino acid sequence of SEQ ID NO: 2 or polymorphic variant thereof. In preferred embodiments, a probe or primer comprises 100 or fewer nucleotides, in certain embodiments, from 6 to 50 nucleotides, for example, from 12 to 30 nucleotides. In other embodiments, the probe or primer is at least 70% identical to the contiguous nucleic acid sequence or to the complement of the contiguous nucleotide sequence, for example, at least 80% identical, in certain embodiments at least 90% identical, and in other embodiments at least 95% identical, or even capable of selectively hybridizing to the contiguous nucleic acid sequence or to the complement of the contiguous nucleotide sequence. Often, the probe or primer further comprises a label, e.g., radioisotope, fluorescent compound, enzyme, or enzyme co-factor.

Particularly useful probes and primers of the invention are those which hybridize to marker locations (e.g. in the FLAP gene) and those that permit amplication (e.g. using PCR) of a small DNA fragment that include a marker of interest, especially markers that form haplotypes of the invention, Kits containing one or two or three or more of such probes and primers are contemplated as aspects of the invention.

The nucleic acid molecules of the invention such as those described above can be identified and isolated using standard molecular biology techniques and the sequence information provided herein. For example, nucleic acid molecules can be amplified and isolated using the polymerase chain reaction and synthetic oligonucleotide primers based on one or more of SEQ ID NOs: 1 or 3, or the complement thereof, or designed based on nucleotides based on sequences encoding one or more of the amino acid sequences provided herein. See generally PCR *Technology: Principles and Applications for DNA Amplification* (ed. H. A. Erlich, Freeman Press, NY, N.Y., 1992); *PCR Protocols: A Guide to Methods and Applications* (Eds. Innis et al., Academic Press, San Diego, Calif., 1990); Mattila et al., *Nucl. Acids Res.* 19:4967 (1991); Eckert et al., *PCR Methods and Applications* 1:17 (1991); PCR (eds. McPherson et al., IRL Press, Oxford); and U.S. Pat. No. 4,683,202. The nucleic acid molecules can be amplified using cDNA, mRNA or genomic DNA as a template, cloned into an appropriate vector and characterized by DNA sequence analysis.

Other suitable amplification methods include the ligase chain reaction (LCR) (see Wu and Wallace, *Genomics* 4:560 (1989), Landegren et al., *Science* 241:1077 (1988), transcription amplification (Kwoh et al., *Proc. Natl. Acad. Sci. USA* 86:1173 (1989)), and self-sustained sequence replication (Guatelli et al., *Proc. Nat. Acad. Sci. USA* 87:1874 (1990)) and nucleic acid based sequence amplification (NASBA). The latter two amplification methods involve isothermal reactions based on isothermal transcription, which produce both single stranded RNA (ssRNA) and double stranded DNA (dsDNA) as the amplification products in a ratio of about 30 or 100 to 1, respectively.

The amplified DNA can be labeled, for example, radiolabeled, and used as a probe for screening a cDNA library derived from human cells, mRNA in zap express, ZIPLOX or other suitable vector. Corresponding clones can be isolated, DNA can obtained following in vivo excision, and the cloned insert can be sequenced in either or both orientations by art recognized methods to identify the correct reading frame encoding a polypeptide of the appropriate molecular weight. For example, the direct analysis of the nucleic acid molecules of the present invention can be accomplished using well-known methods that are commercially available. See, for example, Sambrook et al., *Molecular Cloning, A Laboratory Manual* (2nd Ed., CSHP, New York 1989); Zyskind et al., *Recombinant DNA Laboratory Manual*, (Acad. Press, 1988)). Using these or similar methods, the polypeptide and the DNA encoding the polypeptide can be isolated, sequenced and further characterized.

Antisense nucleic acid molecules of the invention can be designed using the nucleotide sequences of SEQ ID NOs: 1 or 3 and/or the complement of one or more of SEQ ID NOs: 1 or 3 and/or a portion of one or more of SEQ ID NOs: 1 or 3 or the complement of one or more of SEQ ID NOs: 1 or 3 and/or a sequence encoding the amino acid sequences of SEQ ID NOs: 2 or encoding a portion of one or more of SEQ ID NOs: 1 or 3 or their complement. They can be constructed using chemical synthesis and enzymatic ligation reactions using procedures known in the art. For example, an antisense nucleic acid molecule (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Alternatively, the antisense nucleic acid molecule can be produced biologically using an expression vector into which a nucleic acid molecule has been subcloned in an antisense orientation (i.e., RNA transcribed from the inserted nucleic acid molecule will be of an antisense orientation to a target nucleic acid of interest).

The nucleic acid sequences can also be used to compare with endogenous DNA sequences in patients to identify one or more of the disorders related to FLAP, and as probes, such as to hybridize and discover related DNA sequences or to subtract out known sequences from a sample. The nucleic acid sequences can further be used to derive primers for genetic fingerprinting, to raise anti-polypeptide antibodies using DNA immunization techniques, and as an antigen to raise anti-DNA antibodies or elicit immune responses. Portions or fragments of the nucleotide sequences identified herein (and the corresponding complete gene sequences) can be used in numerous ways as polynucleotide reagents. For example, these sequences can be used to: (i) map their respective genes on a chromosome; and, thus, locate gene regions or nucleic acid regions associated with genetic disease; (ii) identify an individual from a minute biological sample (tissue typing); and (iii) aid in forensic identification of a biological sample. Additionally, the nucleotide sequences of the invention can be used to identify and express recombinant polypeptides for analysis, characterization or therapeutic use, or as markers for tissues in which the corresponding polypeptide is expressed, either constitutively, during tissue differentiation, or in diseased states. The nucleic acid sequences can additionally be used as reagents in the screening and/or diagnostic assays described herein, and can also be included as components of kits (e.g., reagent kits) for use in the screening and/or diagnostic assays described herein.

Vectors

Another aspect of the invention pertains to nucleic acid constructs containing a nucleic acid molecule of SEQ ID NOs: 1, 3, 718 or 719 or the complement thereof (or a portion thereof). Yet another aspect of the invention pertains to nucleic acid constructs containing a nucleic acid molecule encoding an amino acid of SEQ ID NO: 2, SEQ ID NO: 720 or polymorphic variant thereof. The constructs comprise a vector (e.g., an expression vector) into which a sequence of the invention has been inserted in a sense or antisense orientation. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors, such as expression vectors, are capable of directing the expression of genes or nucleic acids to which they are operably linked. In general, expression vectors of utility in recombinant DNA techniques are often in the form of plasmids. However, the invention is intended to include such other forms of expression vectors, such as viral vectors (e.g., replication defective retroviruses, adenoviruses and adeno-associated viruses) that serve equivalent functions.

Preferred recombinant expression vectors of the invention comprise a nucleic acid molecule of the invention in a form suitable for expression of the nucleic acid molecule in a host cell. This means that the recombinant expression vectors include one or more regulatory sequences, selected on the basis of the host cells to be used for expression, which is operably linked to the nucleic acid sequence to be expressed. Within a recombinant expression vector, "operably linked" or "operatively linked" is intended to mean that the nucleic acid sequence of interest is linked to the regulatory sequence(s) in a manner which allows for expression of the nucleic acid sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, "Gene Expression Technology", *Methods in Enzymology* 185, Academic Press, San Diego, Calif. (1990). Regulatory sequences include those which direct constitutive expression of a nucleic acid sequence in many types of host cell and those which direct expression of the nucleic acid sequence only in certain host cells (e.g., tissue-specific regulatory sequences). It will be appreciated by those skilled in the art that the design of the expression vector can depend on such factors as the choice of the host cell to be transformed and the level of expression of polypeptide desired. The expression vectors of the invention can be introduced into host cells to thereby produce polypeptides, including fusion polypeptides, encoded by nucleic acid molecules as described herein.

The recombinant expression vectors of the invention can be designed for expression of a polypeptide of the invention in prokaryotic or eukaryotic cells, e.g., bacterial cells such as *E. coli*, insect cells (using baculovirus expression vectors), yeast cells or mammalian cells. Suitable host cells are discussed further in Goeddel, supra. Alternatively, the recombinant expression vector can be transcribed and translated in vitro, for example using T7 promoter regulatory sequences and T7 polymerase.

Another aspect of the invention pertains to host cells into which a recombinant expression vector of the invention has been introduced. The terms "host cell" and "recombinant host cell" are used interchangeably herein. It is understood that such terms refer not only to the particular subject cell but also to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, a nucleic acid molecule of the invention can be expressed in bacterial cells (e.g., *E. coli*), insect cells, yeast or mammalian cells (such as Chinese hamster ovary cells (CHO) or COS cells). Other suitable host cells are known to those skilled in the art.

Vector DNA can be introduced into prokaryotic or eukaryotic cells via conventional transformation or transfection techniques. As used herein, the terms "transformation" and "transfection" are intended to refer to a variety of art-recognized techniques for introducing a foreign nucleic acid molecule (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook, et al. (supra), and other laboratory manuals.

For stable transfection of mammalian cells, it is known that, depending upon the expression vector and transfection technique used, only a small fraction of cells may integrate the foreign DNA into their genome. In order to identify and select these integrants, a gene or nucleic acid that encodes a selectable marker (e.g., for resistance to antibiotics) is generally introduced into the host cells along with the gene or nucleic acid of interest. Preferred selectable markers include those that confer resistance to drugs, such as G418, hygromycin and methotrexate. Nucleic acid molecules encoding a selectable marker can be introduced into a host cell on the same vector as the nucleic acid molecule of the invention or can be introduced on a separate vector. Cells stably transfected with the introduced nucleic acid molecule can be identified by drug selection (e.g., cells that have incorporated the selectable marker gene or nucleic acid will survive, while the other cells die).

A host cell of the invention, such as a prokaryotic host cell or eukaryotic host cell in culture can be used to produce (i.e., express) a polypeptide of the invention. Accordingly, the invention further provides methods for producing a polypeptide using the host cells of the invention. In one embodiment, the method comprises culturing the host cell of invention (into which a recombinant expression vector encoding a polypeptide of the invention has been introduced) in a suitable medium such that the polypeptide is produced. In another embodiment, the method further comprises isolating the polypeptide from the medium or the host cell.

The host cells of the invention can also be used to produce nonhuman transgenic animals. For example, in one embodiment, a host cell of the invention is a fertilized oocyte or an embryonic stem cell into which a nucleic acid molecule of the invention has been introduced (e.g., an exogenous FLAP nucleic acid, or an exogenous nucleic acid encoding a FLAP polypeptide). Such host cells can then be used to create nonhuman transgenic animals in which exogenous nucleotide sequences have been introduced into the genome or homologous recombinant animals in which endogenous nucleotide sequences have been altered. Such animals are useful for studying the function and/or activity of the nucleic acid sequence and polypeptide encoded by the sequence and for identifying and/or evaluating modulators of their activity. As used herein, a "transgenic animal" is a non-human animal, preferably a mammal, more preferably a rodent such as a rat or mouse, in which one or more of the cells of the animal include a transgene. Other examples of transgenic animals include non-human primates, sheep, dogs, cows, goats, chickens and amphibians. A transgene is exogenous DNA which is integrated into the genome of a cell from which a transgenic animal develops and which remains in the genome of the mature animal, thereby directing the expression of an encoded gene product in one or more cell types or tissues of the transgenic animal. As used herein, a "homologous recombinant animal" is a non-human animal, preferably a mammal, more preferably a mouse, in which an endogenous gene has been altered by homologous recombination between the endogenous gene and an exogenous DNA molecule introduced into a cell of the animal, e.g., an embryonic cell of the animal, prior to development of the animal.

Methods for generating transgenic animals via embryo manipulation and microinjection, particularly animals such as mice, have become conventional in the art and are described, for example, in U.S. Pat. Nos. 4,736,866 and 4,870,009, U.S. Pat. No. 4,873,191 and in Hogan, Manipulating the Mouse Embryo (Cold Spring Harbor Laboratory Press, Cold Spring Harbor, N.Y., 1986). Methods for constructing homologous recombination vectors and homologous recombinant animals are described further in Bradley, Current Opinion in BioTechnology 2:823-829 (1991) and in PCT Publication Nos. WO 90/11354, WO 91/01140, WO 92/0968, and WO 93/04169. Clones of the non-human transgenic animals described herein can also be produced according to the methods described in Wilmut et al., Nature 385: 810-813 (1997) and PCT Publication Nos. WO 97/07668 and WO 97/07669.

Polypeptides of the Invention

The present invention pertains to isolated polypeptides encoded by FLAP nucleic acids ("FLAP polypeptides"), and fragments and variants thereof, as well as polypeptides encoded by nucleotide sequences described herein (e.g., other splicing variants). The present invention also pertains to isolated polypeptides encoded by LTA4H nucleic acids ("LTA4H polypeptides"), and fragments and variants thereof, as well as polypeptides encoded by nucleotide sequences described herein (e.g., other splicing variants)The term "polypeptide" refers to a polymer of amino acids, and not to a specific length; thus, peptides, oligopeptides and proteins are included within the definition of a polypeptide. As used herein, a polypeptide is said to be "isolated" or "purified" when it is substantially free of cellular material when it is isolated from recombinant and non-recombinant cells, or free of chemical precursors or other chemicals when it is chemically synthesized. A polypeptide, however, can be joined to another polypeptide with which it is not normally associated in a cell (e.g., in a "fusion protein") and still be "isolated" or "purified." A detailed discussion of the methods to make a polypeptide of the invention is provided in International Application No. PCT/US03/32556, filed on Oct. 16, 2003, which is incorporated by reference herein in its entirety.

Antibodies of the Invention

Polyclonal and/or monoclonal antibodies that specifically bind one form of the polypeptide or nucleic acid product (e.g., a polypeptide encoded by a nucleic acid having a SNP as set forth in Table 13), but not to another form of the polypeptide or nucleic acid product, are also provided. Antibodies are also provided which bind a portion of either polypeptide encoded by nucleic acids of the invention (e.g., SEQ ID NO: 1 or SEQ ID NO: 3 or SEQ ID NO: 718 or SEQ ID NO: 719, or the complement thereof), or to a polypeptide encoded by nucleic acids of the invention that contain a polymorphic site or sites. The invention also provides antibodies to the polypeptides and polypeptide fragments of the invention, or a portion thereof, or having an amino acid sequence encoded by a nucleic acid molecule comprising all or a portion of SEQ ID NOs: 1, 3, 718 or 719, or the complement thereof, or another variant or portion thereof. A detailed discussion of the methods to make the antibodies of the invention is provided in International Application No. PCT/US03/32556, filed on Oct. 16, 2003, which is incorporated by reference herein in its entirety.

Diagnostic Assays

The nucleic acids, probes, primers, polypeptides and antibodies described herein can be used in methods of diagnosis of a susceptibility to MI, ACS, stroke or PAOD, or to another disease or condition associated with an MI gene, such as FLAP or LTA4H, as well as in kits useful for diagnosis of a susceptibility to MI, ACS, stroke or PAOD, or to another disease or condition associated with FLAP or LTA4H. In one embodiment, the kit useful for diagnosis of susceptibility to MI, ACS, stroke or PAOD, or to another disease or condition associated with FLAP or LTA4H comprises primers as described herein, wherein the primers contain one or more of the SNPs identified in Table 13 or Table 37.

In one embodiment of the invention, diagnosis of susceptibility to MI, ACS, stroke or PAOD (or diagnosis of susceptibility to another disease or condition associated with FLAP or LTA4H), is made by detecting a polymorphism in a FLAP or LTA4H nucleic acid as described herein. The polymorphism can be an alteration in a FLAP or LTA4H nucleic acid, such as the insertion or deletion of a single nucleotide, or of more than one nucleotide, resulting in a frame shift alteration; the change of at least one nucleotide, resulting in a change in the encoded amino acid; the change of at least one nucleotide, resulting in the generation of a premature stop codon; the deletion of several nucleotides, resulting in a deletion of one or more amino acids encoded by the nucleotides; the insertion of one or several nucleotides, such as by unequal recombination or gene conversion, resulting in an interruption of the coding sequence of the gene or nucleic acid; duplication of all or a part of the gene or nucleic acid; transposition of all or a part of the gene or nucleic acid; or rearrangement of all or a part of the gene or nucleic acid. More than one such alteration may be present in a single gene or nucleic acid. Such sequence changes cause an alteration in the polypeptide encoded by a FLAP or LTA4H nucleic acid. For example, if the alteration is a frame shift alteration, the frame shift can result in a change in the encoded amino acids, and/or can result in the generation of a premature stop codon, causing generation of a truncated polypeptide. Alternatively, a polymorphism associated with a disease or condition associated with a FLAP or LTA4H nucleic acid or a susceptibility to a disease or condition associated with a FLAP or LTA4H nucleic acid can be a synonymous alteration in one or more nucleotides (i.e., an alteration that does not result in a change in the polypeptide encoded by a FLAP nucleic acid or LTA4H nucleic acid). Such a polymorphism may alter splicing sites, affect the stability or transport of mRNA, or otherwise affect the transcription or translation of the nucleic acid. A FLAP nucleic acid or a LTA4H nucleic acid that has any of the alteration described above is referred to herein as an "altered nucleic acid."

In a first method of diagnosing a susceptibility to MI, ACS, stroke or PAOD, hybridization methods, such as Southern analysis, Northern analysis, or in situ hybridizations, can be used (see *Current Protocols in Molecular Biology*, Ausubel, F. et al., eds., John Wiley & Sons, including all supplements through 1999). For example, a biological sample from a test subject (a "test sample") of genomic DNA, RNA, or cDNA, is obtained from an individual suspected of having, being susceptible to or predisposed for, or carrying a defect for, a susceptibility to a disease or condition associated with a FLAP nucleic acid or a disease or condition associated with a LTA4H nucleic acid (the "test individual"). The individual can be an adult, child, or fetus. The test sample can be from any source which contains genomic DNA, such as a blood sample, sample of amniotic fluid, sample of cerebrospinal fluid, or tissue sample from skin, muscle, buccal or conjunctival mucosa, placenta, gastrointestinal tract or other organs. A test sample of DNA from fetal cells or tissue can be obtained by appropriate methods, such as by amniocentesis or chorionic villus sampling. The DNA, RNA, or cDNA sample is then examined to determine whether a polymorphism in an MI nucleic acid is present, and/or to determine which splicing variant(s) encoded by the FLAP or LTA4H is present. The presence of the polymorphism or splicing variant(s) can be indicated by hybridization of the nucleic acid in the genomic DNA, RNA, or cDNA to a nucleic acid probe. A "nucleic acid probe," as used herein, can be a DNA probe or an RNA probe; the nucleic acid probe can contain at least one polymorphism in a FLAP nucleic acid, LTA4H nucleic acid or contains a nucleic acid encoding a particular splicing variant of a FLAP nucleic acid or a particular splicing variant of a LTA4H nucleic acid. The probe can be any of the nucleic acid molecules described above (e.g., the nucleic acid, a fragment, a vector comprising the nucleic acid, a probe or primer, etc.).

To diagnose a susceptibility to MI, ACS, stroke or PAOD (or another disease or condition associated with FLAP), the test sample containing a FLAP nucleic acid is contacted with at least one nucleic acid probe to form a hybridization sample. A preferred probe for detecting mRNA or genomic DNA is a labeled nucleic acid probe capable of hybridizing to mRNA or genomic DNA sequences described herein. The nucleic acid probe can be, for example, a full-length nucleic acid molecule, or a portion thereof, such as an oligonucleotide of at least 15, 30, 50, 100, 250 or 500 nucleotides in length and sufficient to specifically hybridize under stringent conditions to appropriate mRNA or genomic DNA. For example, the nucleic acid probe can be all or a portion of one of SEQ ID NOs: 1, 3, 718 or 719 or the complement thereof or a portion thereof; or can be a nucleic acid encoding all or a portion of one of SEQ ID NO: 2 or 720. Other suitable probes for use in the diagnostic assays of the invention are described above (see e.g., probes and primers discussed under the heading, "Nucleic Acids of the Invention").

The hybridization sample is maintained under conditions that are sufficient to allow specific hybridization of the nucleic acid probe to a FLAP nucleic acid or a LTA4H nucleic acid. "Specific hybridization," as used herein, indicates exact hybridization (e.g., with no mismatches). Specific hybridization can be performed under high stringency conditions or moderate stringency conditions, for example, as described above. In a particularly preferred embodiment, the hybridization conditions for specific hybridization are high stringency.

Specific hybridization, if present, is then detected using standard methods. If specific hybridization occurs between the nucleic acid probe and FLAP nucleic acid in the test sample, then the FLAP has the polymorphism, or is the splicing variant, that is present in the nucleic acid probe. More than one nucleic acid probe can also be used concurrently in this method. Specific hybridization of any one of the nucleic acid probes is indicative of a polymorphism in the FLAP nucleic acid, or of the presence of a particular splicing variant encoding the FLAP nucleic acid, and is therefore diagnostic for a susceptibility to a disease or condition associated with FLAP (e.g., MI, ACS, stroke or PAOD).

In addition, if specific hybridization occurs between the nucleic acid probe and LTA4H nucleic acid in the test sample, then the LTA4H has the polymorphism, or is the splicing variant, that is present in the nucleic acid probe. More than one nucleic acid probe can also be used concurrently in this method. Specific hybridization of any one of the nucleic acid probes is indicative of a polymorphism in the LTA4H nucleic acid, or of the presence of a particular splicing variant encoding the LTA4H nucleic acid, and is therefore diagnostic for a susceptibility to a disease or condition associated with LTA4H (e.g., MI, ACS, stroke or PAOD).

In Northern analysis (see *Current Protocols in Molecular Biology*, Ausubel, F. et al., eds., John Wiley & Sons, supra) the hybridization methods described above are used to identify the presence of a polymorphism or a particular splicing variant, associated with a susceptibility to a disease or condition associated with FLAP or LTA4H (e.g., MI, ACS, stroke or PAOD). For Northern analysis, a test sample of RNA is obtained from the individual by appropriate means. Specific hybridization of a nucleic acid probe, as described above, to RNA from the individual is indicative of a polymorphism in a FLAP nucleic acid, or of the presence of a particular splicing variant encoded by a FLAP nucleic acid, a polymorphism in a LTA4H nucleic acid, or of the presence of a particular splicing variant encoded by a LTA4H nucleic acid and is therefore diagnostic for susceptibility to a disease or condition associated with FLAP or LTA4H (e.g., MI, ACS, stroke or PAOD).

For representative examples of use of nucleic acid probes, see, for example, U.S. Pat. Nos. 5,288,611 and 4,851,330.

Alternatively, a peptide nucleic acid (PNA) probe can be used instead of a nucleic acid probe in the hybridization methods described above. PNA is a DNA mimic having a peptide-like, inorganic backbone, such as N-(2-aminoethyl) glycine units, with an organic base (A, G, C, T or U) attached to the glycine nitrogen via a methylene carbonyl linker (see, for example, Nielsen, P. E. et al., *Bioconjugate Chemistry* 5, American Chemical Society, p. 1 (1994). The PNA probe can be designed to specifically hybridize to a nucleic acid having a polymorphism associated with a susceptibility to a disease or condition associated with FLAP (e.g., MI). Hybridization of the PNA probe to a FLAP nucleic acid as described herein is diagnostic for the susceptibility to the disease or condition.

In another method of the invention, mutation analysis by restriction digestion can be used to detect an altered nucleic acid, or nucleic acids containing a polymorphism(s), if the mutation or polymorphism in the nucleic acid results in the creation or elimination of a restriction site. A test sample containing genomic DNA is obtained from the individual. Polymerase chain reaction (PCR) can be used to amplify a FLAP nucleic acid or a LTA4H nucleic acid (and, if necessary, the flanking sequences) in the test sample of genomic DNA from the test individual. RFLP analysis is conducted as described (see *Current Protocols in Molecular Biology*, supra). The digestion pattern of the relevant DNA fragment indicates the presence or absence of the alteration or polymorphism in the FLAP nucleic acid or LTA4H nucleic acid, and therefore indicates the presence or absence of the susceptibility to a disease or condition associated with FLAP or LTA4H (e.g., MI, ACS, stroke or PAOD).

Sequence analysis can also be used to detect specific polymorphisms in the FLAP nucleic acid. A test sample of DNA or RNA is obtained from the test individual. PCR or other appropriate methods can be used to amplify the nucleic acid, and/or its flanking sequences, if desired. The sequence of a FLAP nucleic acid, or a fragment of the nucleic acid, or cDNA, or fragment of the cDNA, or mRNA, or fragment of the mRNA, is determined, using standard methods. The sequence of the nucleic acid, nucleic acid fragment, cDNA, cDNA fragment, mRNA, or mRNA fragment is compared with the known nucleic acid sequence of the nucleic acid, cDNA (e.g., one or more of SEQ ID NOs: 1, 3, 718 or 719and/or the complement of SEQ ID NO: 1, 3, 718 or 719), or a nucleic acid sequence encoding SEQ ID NO: 2, SEQ ID NO: 720 or a fragment thereof) or mRNA, as appropriate. The presence of a polymorphism in the FLAP or LTA4H indicates that the individual has a susceptibility to a disease associated with FLAP or LTA4H (e.g., MI, ACS, stroke or PAOD).

Allele-specific oligonucleotides can also be used to detect the presence of polymorphism(s) in the FLAP nucleic acid or the LTA4H nucleic acid, through the use of dot-blot hybridization of amplified oligonucleotides with allele-specific oligonucleotide (ASO) probes (see, for example, Saiki, R. et al., *Nature* 324:163-166 (1986)). An "allele-specific oligonucleotide" (also referred to herein as an "allele-specific oligonucleotide probe") is an oligonucleotide of approximately 10-50 base pairs, for example, approximately 15-30 base pairs, that specifically hybridizes to a FLAP nucleic acid, and that contains a polymorphism associated with a susceptibility to a disease or condition associated with FLAP or LTA4H (e.g., MI, ACS, stroke or PAOD). An allele-specific oligonucleotide probe that is specific for particular polymorphisms in a FLAP or LTA4H nucleic acid can be prepared, using standard methods (see *Current Protocols in Molecular Biology*, supra). To identify polymorphisms in the nucleic acid associated with susceptibility to disease, a test sample of DNA is obtained from the individual. PCR can be used to amplify all or a fragment of a FLAP nucleic acid or LTA4H nucleic acid, and their flanking sequences. The DNA containing the amplified FLAP or LTA4H nucleic acid (or fragment of the nucleic acid) is dot-blotted, using standard methods (see *Current Protocols in Molecular Biology*, supra), and the blot is contacted with the oligonucleotide probe. The presence of specific hybridization of the probe to the amplified FLAP or LTA4H is then detected. Specific hybridization of an allele-specific oligonucleotide probe to DNA from the individual is indicative of a polymorphism in the FLAP or a polymorphism in the LTA4H and is therefore indicative of a susceptibility to a disease or condition associated with FLAP or LTA4H respectively (e.g., MI, ACS, stroke or PAOD).

An allele-specific primer hybridizes to a site on target DNA overlapping a polymorphism and only primes amplification of an allelic form to which the primer exhibits perfect complementarity. See Gibbs, *Nucleic Acid Res.* 17, 2427-2448 (1989). This primer is used in conjunction with a second primer which hybridizes at a distal site. Amplification proceeds from the two primers, resulting in a detectable product which indicates the particular allelic form is present. A control is usually performed with a second pair of primers, one of which shows a single base mismatch at the polymorphic site and the other of which exhibits perfect complementarity to a distal site. The single-base mismatch prevents amplification and no detectable product is formed. The method works best when the mismatch is included in the 3'-most position of the oligonucleotide aligned with the polymorphism because this position is most destabilizing to elongation from the primer (see, e.g., WO 93/22456).

With the addition of such analogs as locked nucleic acids (LNAs), the size of primers and probes can be reduced to as few as 8 bases. LNAs are a novel class of bicyclic DNA analogs in which the 2' and 4' positions in the furanose ring are joined via an O-methylene (oxy-LNA), S-methylene (thio-LNA), or amino methylene (amino-LNA) moiety. Common to all of these LNA variants is an affinity toward complementary nucleic acids, which is by far the highest reported for a DNA analog. For example, particular all oxy-LNA nonamers have been shown to have melting temperatures of 64° C. and 74° C. when in complex with complementary DNA or RNA, respectively, as oposed to 28° C. for both DNA and RNA for the corresponding DNA nonamer. Substantial increases in $T_m$ are also obtained when LNA monomers are used in combination with standard DNA or RNA monomers. For primers and probes, depending on where the LNA monomers are included (e.g., the 3' end, the 5'end, or in the middle), the $T_m$ could be increased considerably.

In another embodiment, arrays of oligonucleotide probes that are complementary to target nucleic acid sequence segments from an individual, can be used to identify polymorphisms in a FLAP nucleic acid or a LTA4H nucleic acid For example, in one embodiment, an oligonucleotide array can be used. Oligonucleotide arrays typically comprise a plurality of different oligonucleotide probes that are coupled to a surface of a substrate in different known locations. These oligonucleotide arrays, also described as "Genechips™," have been generally described in the art, for example, U.S. Pat. No.

5,143,854 and PCT patent publication Nos. WO 90/15070 and WO 92/10092. These arrays can generally be produced using mechanical synthesis methods or light directed synthesis methods that incorporate a combination of photolithographic methods and solid phase oligonucleotide synthesis methods. See Fodor et al., Science 251:767-777 (1991); Pirrung et al., U.S. Pat. No. 5,143,854; (see also PCT Application WO 90/15070); Fodor et al, PCT Publication WO 92/10092; and U.S. Pat. No. 5,424,186, the entire teachings of each of which are incorporated by reference herein. Techniques for the synthesis of these arrays using mechanical synthesis methods are described in, e.g., U.S. Pat. No. 5,384,261, the entire teachings of which are incorporated by reference herein. In another example, linear arrays can be utilized.

Once an oligonucleotide array is prepared, a nucleic acid of interest is hybridized with the array and scanned for polymorphisms. Hybridization and scanning are generally carried out by methods described herein and also in, e.g., published PCT Application Nos. WO 92/10092 and WO 95/11995, and U.S. Pat. No. 5,424,186, the entire teachings of which are incorporated by reference herein. In brief, a target nucleic acid sequence that includes one or more previously identified polymorphic markers is amplified using well-known amplification techniques, e.g., PCR. Typically, this involves the use of primer sequences that are complementary to the two strands of the target sequence both upstream and downstream from the polymorphism. Asymmetric PCR techniques may also be used. Amplified target, generally incorporating a label, is then hybridized with the array under appropriate conditions. Upon completion of hybridization and washing of the array, the array is scanned to determine the position on the array to which the target sequence hybridizes. The hybridization data obtained from the scan is typically in the form of fluorescence intensities as a function of location on the array. In a reverse method, a probe, containing a polymorphism, can be coupled to a solid surface and PCR amplicons are then added to hybridize to these probes.

Although primarily described in terms of a single detection block, e.g., detection of a single polymorphism arrays can include multiple detection blocks, and thus be capable of analyzing multiple, specific polymorphisms. It will generally be understood that detection blocks may be grouped within a single array or in multiple, separate arrays so that varying, optimal conditions may be used during the hybridization of the target to the array. For example, it may often be desirable to provide for the detection of those polymorphisms that fall within G-C rich stretches of a genomic sequence, separately from those falling in A-T rich segments. This allows for the separate optimization of hybridization conditions for each situation.

Additional uses of oligonucleotide arrays for detection of polymorphisms can be found, for example, in U.S. Pat. Nos. 5,858,659 and 5,837,832, the entire teachings of which are incorporated by reference herein. Other methods of nucleic acid analysis can be used to detect polymorphisms in a nucleic acid described herein, or variants encoded by a nucleic acid described herein. Representative methods include direct manual sequencing (Church and Gilbert, *Proc. Natl. Acad. Sci. USA* 81:1991-1995 (1988); Sanger et al., *Proc. Natl. Acad. Sci., USA* 74:5463-5467 (1977); Beavis et al. U.S. Pat. No. 5,288,644); automated fluorescent sequencing; single-stranded conformation polymorphism assays (SSCP); clamped denaturing gel electrophoresis (CDGE); denaturing gradient gel electrophoresis (DGGE) (Sheffield, V. C. et al., *Proc. Natl. Acad. Sci. USA* 86:232-236 (1989)), mobility shift analysis (Orita, M. et al., *Proc. Natl. Acad. Sci. USA* 86:2766-2770 (1989)), restriction enzyme analysis (Flavell et al., *Cell* 15:25 (1978); Geever, et al., *Proc. Natl. Acad. Sci. USA* 78:5081 (1981)); heteroduplex analysis; chemical mismatch cleavage (CMC) (Cotton et al., *Proc. Natl. Acad. Sci. USA* 85:4397-4401 (1985)); RNase protection assays (Myers, R. M. et al., *Science* 230:1242 (1985)); use of polypeptides which recognize nucleotide mismatches, such as *E. coli* mutS protein; allele-specific PCR, for example.

In one embodiment of the invention, diagnosis of a susceptibility to a disease or condition associated with FLAP or LTA4H (e.g., MI, ACS, stroke or PAOD) can also be made by expression analysis by quantitative PCR (kinetic thermal cycling). This technique utilizing TaqMan® can be used to allow the identification of polymorphisms and whether a patient is homozygous or heterozygous. The technique can assess the presence of an alteration in the expression or composition of the polypeptide encoded by a FLAP nucleic acid or splicing variants encoded by a FLAP nucleic acid. The technique can likewise assess the presence of an alteration in the expression or composition of the polypeptide encoded by a LTA4H nucleic acid or splicing variants encoded by a LTA4H nucleic acid. Further, the expression of the variants can be quantified as physically or functionally different.

In another embodiment of the invention, diagnosis of a susceptibility to MI, ACS, stroke or PAOD (or of another disease or condition associated with FLAP or LTA4H) can also be made by examining expression and/or composition of a FLAP polypeptide, by a variety of methods, including enzyme linked immunosorbent assays (ELISAs), Western blots, immunoprecipitations and immunofluorescence. A test sample from an individual is assessed for the presence of an alteration in the expression and/or an alteration in composition of the polypeptide encoded by a FLAP nucleic acid, or a polypeptide encoded by a LTA4H nucleic acid or for the presence of a particular variant encoded by a FLAP or LTA4H nucleic acid. An alteration in expression of a polypeptide encoded by a FLAP or LTA4H nucleic acid can be, for example, an alteration in the quantitative polypeptide expression (i.e., the amount of polypeptide produced); an alteration in the composition of a polypeptide encoded by a FLAP or LTA4H nucleic acid is an alteration in the qualitative polypeptide expression (e.g., expression of an altered FLAP polypeptide, LTA4H polypeptide or of a different splicing variant). In a preferred embodiment, diagnosis of a susceptibility to a disease or condition associated with FLAP is made by detecting a particular splicing variant encoded by that FLAP variant, or a particular pattern of splicing variants. In another preferred embodiment, diagnosis of a susceptibility to a disease or condition associated with LTA4H is made by detecting a particular splicing variant encoded by that LTA4H variant, or a particular pattern of splicing variants.

Both such alterations (quantitative and qualitative) can also be present. An "alteration" in the polypeptide expression or composition, refers to an alteration in expression or composition in a test sample, as compared with the expression or composition of polypeptide by a FLAP or LTA4H nucleic acid in a control sample. A control sample is a sample that corresponds to the test sample (e.g., is from the same type of cells), and is from an individual who is not affected by the disease or a susceptibility to a disease or condition associated with a FLAP or LTA4H nucleic acid. An alteration in the expression or composition of the polypeptide in the test sample, as compared with the control sample, is indicative of a susceptibility to a disease or condition associated with FLAP or LTA4H (e.g., MI, ACS, stroke or PAOD). Similarly, the presence of one or more different splicing variants in the test sample, or the presence of significantly different amounts of different splicing variants in the test sample, as compared with the control sample, is indicative of a susceptibility to a disease or condition associated with a FLAP or LTA4H nucleic acid. Various means of examining expression or composition of the polypeptide encoded by a FLAP or LTA4H nucleic acid can be used, including: spectroscopy, colorimetry, electrophoresis, isoelectric focusing and immunoassays (e.g., David et al., U.S. Pat. No. 4,376,110) such as immunoblotting (see also *Current Protocols in Molecular Biology*, particularly Chapter 10). For example, in one embodiment, an antibody capable of binding to the polypeptide (e.g., as described above), preferably an antibody with a detectable label, can be used. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end-labeling of a DNA probe with biotin such that it can be detected with fluorescently labeled streptavidin.

Western blotting analysis, using an antibody as described above that specifically binds to a polypeptide encoded by an altered FLAP (e.g., by a FLAP having a SNP as shown in Table 13) or an antibody that specifically binds to a polypeptide encoded by an altered LTA4H (e.g. by a LTA4H having a SNP as shown in Table 37), or an antibody that specifically binds to a polypeptide encoded by a non-altered nucleic acid, or an antibody that specifically binds to a particular splicing variant encoded by a nucleic acid, can be used to identify the presence in a test sample of a particular splicing variant or of a polypeptide encoded by a polymorphic or altered FLAP or altered LTA4H, or the absence in a test sample of a particular splicing variant or of a polypeptide encoded by a non-polymorphic or non-altered nucleic acid. The presence of a polypeptide encoded by a polymorphic or altered nucleic acid, or the absence of a polypeptide encoded by a non-polymorphic or non-altered nucleic acid, is diagnostic for a susceptibility to a disease or condition associated with FLAP or LTA4H, as is the presence (or absence) of particular splicing variants encoded by the FLAP nucleic acid or the LTA4H nucleic acid.

In one embodiment of this method, the level or amount of polypeptide encoded by a FLAP nucleic acid in a test sample is compared with the level or amount of the polypeptide encoded by the FLAP in a control sample. A level or amount of the polypeptide in the test sample that is higher or lower than the level or amount of the polypeptide in the control sample, such that the difference is statistically significant, is indicative of an alteration in the expression of the polypeptide encoded by the FLAP, and is diagnostic for a susceptibility to a disease or condition associated with that FLAP. Alternatively, the composition of the polypeptide encoded by a FLAP nucleic acid in a test sample is compared with the composition of the polypeptide encoded by the FLAP in a control sample (e.g., the presence of different splicing variants). A difference in the composition of the polypeptide in the test sample, as compared with the composition of the polypeptide in the control sample, is diagnostic for a susceptibility to a disease or condition associated with that FLAP. In another embodiment, both the level or amount and the composition of the polypeptide can be assessed in the test sample and in the control sample. A difference in the amount or level of the polypeptide in the test sample, compared to the control sample; a difference in composition in the test sample, compared to the control sample; or both a difference in the amount or level, and a difference in the composition, is indicative of a susceptibility to a disease or condition associated with FLAP (e.g., MI).

The invention further pertains to a method for the diagnosis and identification of susceptibility to myocardial infarction, ACS, stroke or PAOD in an individual, by identifying an at-risk haplotype in FLAP or by identifying an at-risk haplotype in LTA4H. In one embodiment, the at-risk haplotype is one which confers a significant risk of MI, ACS, stroke or PAOD. In one embodiment, significance associated with a haplotype is measured by an odds ratio. In a further embodiment, the significance is measured by a percentage. In one embodiment, a significant risk is measured as an odds ratio of at least about 1.2, including by not limited to: 1.2, 1.3, 1.4, 1.5, 1.6, 1.7, 1.8, and 1.9. In a further embodiment, an odds ratio of at least 1.2 is significant. In a further embodiment, an odds ratio of at least about 1.5 is significant. In a further embodiment, a significant increase in risk is at least about 1.7 is significant. In a further embodiment, a significant increase in risk is at least about 20%, including but not limited to about 25%, 30%, 35%, 40%, 45%, 50%, 55%, 60%, 65%, 70%, 75%, 80%, 85%, 90%, 95, and 98%. In a further embodiment, a significant increase in risk is at least about 50%. In yet another embodiment, an at-risk haplotype has a p value <0.05. It is understood however, that identifying whether a risk is medically significant may also depend on a variety of factors, including the specific disease, the haplotype, and often, environmental factors.

The invention also pertains to methods of diagnosing a susceptibility to myocardial infarction, ACS, stroke or PAOD in an individual, comprising screening for an at-risk haplotype in the FLAP nucleic acid that is more frequently present in an individual susceptible to myocardial infarction (affected) or by screening for an at-risk haplotype in LTA4H, compared to the frequency of its presence in a healthy individual (control), wherein the presence of the haplotype is indicative of susceptibility to myocardial infarction. Standard techniques for genotyping for the presence of SNPs and/or microsatellite markers that are associated with myocardial infarction, ACS, stroke or PAOD can be used, such as fluorescent based techniques (Chen, et al., *Genome Res.* 9, 492 (1999), PCR, LCR, Nested PCR and other techniques for nucleic acid amplification. In a preferred embodiment, the method comprises assessing in an individual the presence or frequency of SNPs and/or microsatellites in the FLAP nucleic acid that are associated with myocardial infarction, ACS, stroke or PAOD, wherein an excess or higher frequency of the SNPs and/or microsatellites compared to a healthy control individual is indicative that the individual is susceptible to myocardial infarction, ACS, stroke or PAOD. See Table 7 for SNPs that comprise haplotypes that can be used as screening tools. See also Tables 13 and 37 that sets forth SNPs and markers for use as screening tools.

In one embodiment, the at-risk haplotype is characterized by the presence of polymorphism(s) represented in Table 13. For example, SG13S99, where the SNP can be a "C" or a "T"; SG13S25, where the SNP can be a "G" or an "A"; SG13S377, where the SNP can be a "G" or an "A"; SG13S106, where the SNP can be a "G" or an "A"; SG13S114, where the SNP can be a "T" or an "A"; SG13S89, where the SNP can be a "G" or an "A"; SG13S30, where the SNP can be a "G" or a "T"; SG13S32, where the SNP can be a "C" or an "A"; SG13S42, where the SNP can be a "G" or an "A"; and SG13S35, where the SNP can be a "G" or an "A". In addition, SG13A375, where the SNP can be a "T", SG13S32, where the SNP can be an "A", aand SG13S106, where the SNP can be a "G" or an "A".

Kits (e.g., reagent kits) useful in the methods of diagnosis comprise components useful in any of the methods described herein, including for example, hybridization probes or primers as described herein (e.g., labeled probes or primers), reagents for detection of labeled molecules, restriction enzymes (e.g., for RFLP analysis), allele-specific oligonucleotides, antibodies which bind to altered or to non-altered (native) FLAP polypeptide or a non-altered (native) LTA4H polypeptide, means for amplification of nucleic acids comprising a FLAP or LTA4H, or means for analyzing the nucleic acid sequence of a nucleic acid described herein, or for analyzing the amino acid sequence of a polypeptide as described herein, etc. In one embodiment, a kit for diagnosing susceptibility to MI, ACS, stroke or PAOD can comprise primers for nucleic acid amplification of a region in the FLAP nucleic acid or LTA4H nucleic acid comprising an at-risk haplotype that is more frequently present in an individual having MI, ACS, stroke or PAOD or susceptible to MI, ACS, stroke or PAOD. The primers can be designed using portions of the nucleic acids flanking SNPs that are indicative of MI. In a particularly preferred embodiment, the primers are designed to amplify regions of the LTA4H nucleic acid associated with an at-risk haplotype for MI, as shown in Table 41 or Table 42, or more particularly the haplotype defined by the microsatellite markers and SNPs at the locus on chromosome 12q23.

In another particularly preferred embodiment, the primers are designed to amplify regions of the FLAP nucleic acid associated with an at-risk haplotype for MI, ACS, stroke or PAOD, as shown in Table 7, or more particularly the haplotype defined by the following SNP markers: In one embodiment, a haplotype associated with a susceptibility to myocardial infarction, ACS, stroke or PAOD comprises markers SG13S99, SG13S25, SG13S377, SG13S106, SG13S32 and SG13S35 at the 13q12-13 locus. In one particular embodiment, the presence of the alleles T, G, G, G, A and G at SG13S99, SG13S25, SG13S377, SG13S106, SG13S32 and SG13S35, respectively (the B6 haplotype), is diagnostic of susceptibility to myocardial infarction, ACS, stroke or PAOD. In another embodiment, a haplotype associated with a susceptibility to myocardial infarction, ACS, stroke or PAOD comprises markers SG13S99, SG13S25, SG13S106, SG13S30 and SG13S42 at the 13q12-13 locus. In one particular embodiment, the presence of the alleles T, G, G, G and A at SG13S99, SG13S25, SG13S106, SG13S30 and SG13S42, respectively (the B5 haplotype), is diagnostic of susceptibility to myocardial infarction, ACS, stroke or PAOD. In a third embodiment, a haplotype associated with a susceptibility to myocardial infarction, ACS, stroke or PAOD comprises markers SG13S25, SG13S106, SG13S30 and SG13S42 at the 13q12-13 locus. In one particular embodiment, the presence of the alleles G, G, G and A at SG13S25, SG13S106, SG13S30 and SG13S42, respectively (the B4 haplotype), is diagnostic of susceptibility to myocardial infarction, ACS, stroke or PAOD. In a fourth embodiment, a haplotype associated with a susceptibility to myocardial infarction, ACS, stroke or PAOD comprises markers SG13S99, SG13S25, SG13S114, SG13S89 and SG13S32 at the 13q12-13 locus. In one particular embodiment, the presence of the alleles T, G, T, G and A at SG13S99, SG13S25, SG13S114, SG13S89 and SG13S32, respectively (the A5 haplotype), is diagnostic of susceptibility to myocardial infarction, ACS, stroke or PAOD. In a fifth embodiment, a haplotype associated with a susceptibility to myocardial infarction, ACS, stroke or PAOD comprises markers SG13S25, SG13S114, SG13S89 and SG13S32 at the 13q12-12 locus. In one particular embodiment, the presence of the alleles G, T, G and A at SG13S25, SG13S114, SG13S89 and SG13S32, respectively (the A4 haplotype), is diagnostic of susceptibility to myocardial infarction, ACS, stroke or PAOD. In another embodiment, a haplotype associated with a susceptibility to myocardial infarction, ACS, stroke or PAOD comprises marker SG13S375 at the 13q12-13 locus. In one particular embodiment, the presence of T at SG13S375, (the HapC1 haplotype) is diagnostic of susceptibility to to myocardial infarction, ACS, stroke or PAOD. In another embodiment, a haplotype associated with a susceptibility to myocardial infarction, ACS, stroke or PAOD comprises markers SG13S25 and SG13S375 at the 13q12-13 locus. In one particular embodiment, the presence of T and G at SG13S375 and SG13S25, respectively (the HapC2 haplotype) is diagnostic of susceptibility to to myocardial infarction, ACS, stroke or PAOD. In another embodiment, a haplotype associated with a susceptibility to myocardial infarction, ACS, stroke or PAOD comprises markers SG13S25, SG13S375 and SG13S32 at the 13q12-13 locus. In one particular embodiment, the presence of T, G and A at SG13S375, SG13S25 and SG13S32, respectively (the HapC3 haplotype) is diagnostic of susceptibility to to myocardial infarction, ACS, stroke or PAOD. In an additional embodiment, a haplotype associated with a susceptibility to myocardial infarction, ACS, stroke or PAOD comprises markers SG13S25, SG13S375, SG13S32 and SG13S106 at the 13q12-13 locus. In one particular embodiment, the presence of T, G, A and G at SG13S375, SG13S25, SG13S32 and SG13S106, respectively (the HapC4-A) haplotype) is diagnostic of susceptibility to to myocardial infarction, ACS, stroke or PAOD. In one particular embodiment, the presence of T, G, A and A at SG13S375, SG13S25, SG13S32 and SG13S106, respectively (the HapC4-B) haplotype) is diagnostic of susceptibility to to myocardial infarction, ACS, stroke or PAOD.

Screening Assays and Agents Identified Thereby

The invention provides methods (also referred to herein as "screening assays") for identifying the presence of a nucleotide that hybridizes to a nucleic acid of the invention, as well as for identifying the presence of a polypeptide encoded by a nucleic acid of the invention. In one embodiment, the presence (or absence) of a nucleic acid molecule of interest (e.g., a nucleic acid that has significant homology with a nucleic acid of the invention) in a sample can be assessed by contacting the sample with a nucleic acid comprising a nucleic acid of the invention (e.g., a nucleic acid having the sequence of one of SEQ ID NOs: 1, 3, 718 or 719 or the complement thereof, or a nucleic acid encoding an amino acid having the sequence of SEQ ID NO: 2, SEQ ID NO: 720, or a fragment or variant of such nucleic acids), under stringent conditions as described above, and then assessing the sample for the presence (or absence) of hybridization. In a preferred embodiment, high stringency conditions are conditions appropriate for selective hybridization. In another embodiment, a sample containing a nucleic acid molecule of interest is contacted with a nucleic acid containing a contiguous nucleic acid sequence (e.g., a primer or a probe as described above) that is at least partially complementary to a part of the nucleic acid molecule of interest (e.g., a FLAP nucleic acid or a LTA4H nucleic acid), and the contacted sample is assessed for the presence or absence of hybridization. In a preferred embodiment, the nucleic acid containing a contiguous nucleic acid sequence is completely complementary to a part of the nucleic acid molecule of interest.

In any of these embodiments, all or a portion of the nucleic acid of interest can be subjected to amplification prior to performing the hybridization.

In another embodiment, the presence (or absence) of a polypeptide of interest, such as a polypeptide of the invention or a fragment or variant thereof, in a sample can be assessed by contacting the sample with an antibody that specifically hybridizes to the polypeptide of interest (e.g., an antibody such as those described above), and then assessing the sample for the presence (or absence) of binding of the antibody to the polypeptide of interest.

In another embodiment, the invention provides methods for identifying agents (e.g., fusion proteins, polypeptides, peptidomimetics, prodrugs, receptors, binding agents, antibodies, small molecules or other drugs, or ribozymes which alter (e.g., increase or decrease) the activity of the polypeptides described herein, or which otherwise interact with the polypeptides herein. For example, such agents can be agents which bind to polypeptides described herein (e.g., binding agent for members of the leukotriene pathway, such as FLAP binding agents or LTA4H binding agents); which have a stimulatory or inhibitory effect on, for example, activity of polypeptides of the invention; or which change (e.g., enhance or inhibit) the ability of the polypeptides of the invention to interact with members of the leukotriene pathway binding agents (e.g., receptors or other binding agents); or which alter posttranslational processing of the leukotriene pathway member polypeptide, such as a FLAP polypeptide or a LTA4H polypeptide (e.g., agents that alter proteolytic processing to direct the polypeptide from where it is normally synthesized to another location in the cell, such as the cell surface; agents that alter proteolytic processing such that more polypeptide is released from the cell, etc.)

In one embodiment, the invention provides assays for screening candidate or test agents that bind to or modulate the activity of polypeptides described herein (or biologically active portion(s) thereof), as well as agents identifiable by the assays. Test agents can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to polypeptide libraries, while the other four approaches are applicable to polypeptide, non-peptide oligomer or small molecule libraries of compounds (Lam, K. S., *Anticancer Drug Des.* 12:145 (1997)).

In one embodiment, to identify agents which alter the activity of a FLAP polypeptide or a LTA4H polypeptide, a cell, cell lysate, or solution containing or expressing a the polypeptide (e.g., SEQ ID NO: 2, SEQ ID NO; 720 or another splicing variant thereof such as a nucleic acid comprising a SNP as shown in Table 13 or 37), or a fragment or derivative thereof (as described above), can be contacted with an agent to be tested; alternatively, the polypeptide can be contacted directly with the agent to be tested. The level (amount) of polypeptide activity is assessed (e.g., the level (amount) of polypeptide activity is measured, either directly or indirectly), and is compared with the level of activity in a control (i.e., the level of activity of the FLAP or LTA4H polypeptide or active fragment or derivative thereof in the absence of the agent to be tested). If the level of the activity in the presence of the agent differs, by an amount that is statistically significant, from the level of the activity in the absence of the agent, then the agent is an agent that alters the activity of the polypeptide. An increase in the level of polypeptide activity in the presence of the agent relative to the activity in the absence of the agent, indicates that the agent is an agent that enhances the activity. Similarly, a decrease in the level of polypeptide activity in the presence of the agent, relative to the activity in the absence of the agent, indicates that the agent is an agent that inhibits polypeptide activity. In another embodiment, the level of activity of a polypeptide or derivative or fragment thereof in the presence of the agent to be tested, is compared with a control level that has previously been established. A statistically significant difference in the level of the activity in the presence of the agent from the control level indicates that the agent alters polypeptide activity.

The present invention also relates to an assay for identifying agents which alter the expression of a FLAP nucleic acid or a LTA4H nucleic acid (e.g., antisense nucleic acids, fusion proteins, polypeptides, peptidomimetics, prodrugs, receptors, binding agents, antibodies, small molecules or other drugs, or ribozymes; which alter (e.g., increase or decrease) expression (e.g., transcription or translation) of the nucleic acid or which otherwise interact with the nucleic acids described herein, as well as agents identifiable by the assays. For example, a solution containing a nucleic acid encoding a FLAP polypeptide (e.g., a FLAP nucleic acid) or a nucleic acid encoding a LTA4H polypeptide (e.g., a LTA4H nucleic acid) can be contacted with an agent to be tested. The solution can comprise, for example, cells containing the nucleic acid or cell lysate containing the nucleic acid; alternatively, the solution can be another solution that comprises elements necessary for transcription/translation of the nucleic acid. Cells not suspended in solution can also be employed, if desired. The level and/or pattern of FLAP or LTA4H expression (e.g., the level and/or pattern of mRNA or of protein expressed, such as the level and/or pattern of different splicing variants) is assessed, and is compared with the level and/or pattern of expression in a control (i.e., the level and/or pattern of the FLAP expression or LTA4H expression in the absence of the agent to be tested). If the level and/or pattern in the presence of the agent differ, by an amount or in a manner that is statistically significant, from the level and/or pattern in the absence of the agent, then the agent is an agent that alters the expression of the FLAP nucleic acid or alters the expressions f the LTA4H nucleic acid Enhancement of FLAP expression or LTA4H expression indicates that the agent is an activator of FLAP or LTA4H activity. Similarly, inhibition of FLAP expression or LTA4H expression indicates that the agent is a repressor of FLAP or LTA4H activity.

In another embodiment, the level and/or pattern of FLAP polypeptide(s) or LTA4H polypeptide(s) (e.g., different splicing variants) in the presence of the agent to be tested, is compared with a control level and/or pattern that have previously been established. A level and/or pattern in the presence of the agent that differs from the control level and/or pattern by an amount or in a manner that is statistically significant indicates that the agent alters FLAP or LTA4H expression.

In another embodiment of the invention, agents which alter the expression of a FLAP nucleic acid or a LTA4H nucleic acid or which otherwise interact with the nucleic acids described herein, can be identified using a cell, cell lysate, or solution containing a nucleic acid encoding the promoter region of the FLAP or LTA4H nucleic acid operably linked to a reporter gene. After contact with an agent to be tested, the level of expression of the reporter gene (e.g., the level of mRNA or of protein expressed) is assessed, and is compared with the level of expression in a control (i.e., the level of the expression of the reporter gene in the absence of the agent to be tested). If the level in the presence of the agent differs, by an amount or in a manner that is statistically significant, from the level in the absence of the agent, then the agent is an agent that alters the expression of the FLAP or LTA4H nucleic acid, as indicated by its ability to alter expression of a nucleic acid that is operably linked to the FLAP or LTA4H nucleic acid promoter.

Enhancement of the expression of the reporter indicates that the agent is an activator of expression of the gene of interest. Similarly, inhibition of the expression of the reporter indicates that the agent is a repressor of expression of the gene of interest. In another embodiment, the level of expression of the reporter in the presence of the test agent, is compared with a control level that has previously been established. A level in the presence of the agent that differs from the control level by an amount or in a manner that is statistically significant indicates that the agent alters expression.

Agents which alter the amounts of different splicing variants encoded by a FLAP nucleic acid or a LTA4H nucleic acid (e.g., an agent which enhances expression of a first splicing variant, and which inhibits expression of a second splicing variant), as well as agents which stimulate activity of a first splicing variant and inhibit activity of a second splicing variant, can easily be identified using these methods described above.

In one embodiments of the invention, assays can be used to assess the impact of a test agent on the activity of a polypeptide relative to a FLAP binding agent. For example, a cell that expresses a compound that interacts with a FLAP nucleic acid (herein referred to as a "FLAP binding agent", which can be a polypeptide or other molecule that interacts with a FLAP nucleic acid, such as a receptor, or another molecule, such as 5-LO) is contacted with a FLAP in the presence of a test agent, and the ability of the test agent to alter the interaction between the FLAP and the FLAP binding agent is determined. Alternatively, a cell lysate or a solution containing the FLAP binding agent, can be used. An agent which binds to the FLAP or the FLAP binding agent can alter the interaction by interfering with, or enhancing the ability of the FLAP to bind to, associate with, or otherwise interact with the FLAP binding agent.

In other embodiments of the invention, assays can be used to assess the impact of a test agent on the activity of a polypeptide relative to a LTA4H binding agent. For example, a cell that expresses a compound that interacts with a LTA4H nucleic acid (herein referred to as a "LTA4H binding agent", which can be a polypeptide or other molecule that interacts with a LTA4H nucleic acid, such as a receptor, or another molecule) is contacted with a LTA4H in the presence of a test agent, and the ability of the test agent to alter the interaction between the LTA4H and the LTA4H binding agent is determined. Alternatively, a cell lysate or a solution containing the LTA4H binding agent, can be used. An agent which binds to the LTA4H or the LTA4H binding agent can alter the interaction by interfering with, or enhancing the ability of the LTA4H to bind to, associate with, or otherwise interact with the LTA4H binding agent.

Determining the ability of the test agent to bind to a nucleic acid or a nucleic acid binding agent can be accomplished, for example, by coupling the test agent with a radioisotope or enzymatic label such that binding of the test agent to the polypeptide can be determined by detecting the labeled with $^{125}I$, $^{35}S$, $^{14}C$ or $^{3}H$, either directly or indirectly, and the radioisotope detected by direct counting of radioemmission or by scintillation counting. Alternatively, test agents can be enzymatically labeled with, for example, horseradish peroxidase, alkaline phosphatase, or luciferase, and the enzymatic label detected by determination of conversion of an appropriate substrate to product. It is also within the scope of this invention to determine the ability of a test agent to interact with the polypeptide without the labeling of any of the interactants. For example, a microphysiometer can be used to detect the interaction of a test agent with a polypeptide or a polypeptide binding agent without the labeling of either the test agent, the polypeptide, or the polypeptide binding agent. McConnell, H. M. et al., *Science* 257:1906-1912 (1992). As used herein, a "microphysiometer" (e.g., Cytosensor™) is an analytical instrument that measures the rate at which a cell acidifies its environment using a light-addressable potentiometric sensor (LAPS). Changes in this acidification rate can be used as an indicator of the interaction between ligand and polypeptide.

Thus, these receptors can be used to screen for compounds that are agonists for use in treating a disease or condition associated with FLAP or LTA4H or a susceptibility to a disease or condition associated with FLAP or LTA4H, or antagonists for studying a susceptibility to a disease or condition associated with FLAP (e.g., MI, ACS, stroke or PAOD). Drugs can be designed to regulate FLAP activation, that in turn can be used to regulate signaling pathways and transcription events of genes downstream or of proteins or polypeptides interacting with FLAP (e.g., 5-LO).

In another embodiment of the invention, assays can be used to identify polypeptides that interact with one or more polypeptides, as described herein. For example, a yeast two-hybrid system such as that described by Fields and Song (Fields, S. and Song, O., *Nature* 340:245-246 (1989)) can be used to identify polypeptides that interact with one or more FLAP polypeptides. In such a yeast two-hybrid system, vectors are constructed based on the flexibility of a transcription factor that has two functional domains (a DNA binding domain and a transcription activation domain). If the two domains are separated but fused to two different proteins that interact with one another, transcriptional activation can be achieved, and transcription of specific markers (e.g., nutritional markers such as His and Ade, or color markers such as lacZ) can be used to identify the presence of interaction and transcriptional activation. For example, in the methods of the invention, a first vector is used which includes a nucleic acid encoding a DNA binding domain and also a FLAP or LTA4H polypeptide of the invention, splicing variant, or fragment or derivative thereof, and a second vector is used which includes a nucleic acid encoding a transcription activation domain and also a nucleic acid encoding a polypeptide which potentially may interact with the FLAP or LTA4H polypeptide, splicing variant, or fragment or derivative thereof (e.g., a FLAP polypeptide binding agent or receptor, or a LTA4H polypeptide binding agent or receptor). Incubation of yeast containing the first vector and the second vector under appropriate conditions (e.g., mating conditions such as used in the Matchmaker™ system from Clontech (Palo Alto, Calif. USA)) allows identification of colonies that express the markers of interest. These colonies can be examined to identify the polypeptide(s) that interact with the polypeptide of interest or fragment or derivative thereof. Such polypeptides may be useful as agents that alter the activity or expression of a FLAP polypeptide or alter the activity or expression of a LTA4H polypeptide, as described above.

In more than one embodiment of the above assay methods of the present invention, it may be desirable to immobilize either the FLAP or LTA4H, the FLAP or LTA4H binding agent, or other components of the assay on a solid support, in order to facilitate separation of complexed from uncomplexed forms of one or both of the polypeptides, as well as to accommodate automation of the assay. Binding of a test agent to the polypeptide, or interaction of the polypeptide with a binding agent in the presence and absence of a test agent, can be accomplished in any vessel suitable for containing the reactants. Examples of such vessels include microtiter plates, test tubes, and micro-centrifuge tubes. In one embodiment, a fusion protein (e.g., a glutathione-S-transferase fusion protein) can be provided which adds a domain that allows a FLAP or LTA4H nucleic acid or a FLAP or LTA4H binding agent to be bound to a matrix or other solid support.

In one embodiment, modulators of expression of nucleic acid molecules of the invention are identified in a method wherein a cell, cell lysate, or solution containing a nucleic acid encoding a FLAP polypeptide or a LTA4H polypeptide is contacted with a test agent and the expression of appropriate mRNA or polypeptide (e.g., splicing variant(s)) in the cell, cell lysate, or solution, is determined. The level of expression of appropriate mRNA or polypeptide(s) in the presence of the test agent is compared to the level of expression of mRNA or polypeptide(s) in the absence of the test agent. The test agent can then be identified as a modulator of expression based on this comparison. For example, when expression of mRNA or polypeptide is greater (statistically significantly greater) in the presence of the test agent than in its absence, the test agent is identified as a stimulator or enhancer of the mRNA or polypeptide expression. Alternatively, when expression of the mRNA or polypeptide is less (statistically significantly less) in the presence of the test agent than in its absence, the test agent is identified as an inhibitor of the mRNA or polypeptide expression. The level of mRNA or polypeptide expression in the cells can be determined by methods described herein for detecting mRNA or polypeptide.

In yet another embodiment, the invention provides methods for identifying agents (e.g., fusion proteins, polypeptides, peptidomimetics, prodrugs, receptors, binding agents, antibodies, small molecules or other drugs, or ribozymes) which alter (e.g., increase or decrease) the activity of a member of leukotriene pathway binding agent, such as a FLAP binding agent (e.g., 5-LO) or a LTA4H binding agent, as described herein. For example, such agents can be agents which have a stimulatory or inhibitory effect on, for example, the activity of a member of leukotriene pathway binding agent, such as a FLAP binding agent or a LTA4H binding agent; which change (e.g., enhance or inhibit) the ability a member of leukotriene pathway binding agents, (e.g., receptors or other binding agents) to interact with the polypeptides of the invention; or which alter posttranslational processing of the member of leukotriene pathway binding agent, (e.g., agents that alter proteolytic processing to direct the member of the leukotriene pathway binding agent from where it is normally synthesized to another location in the cell, such as the cell surface; agents that alter proteolytic processing such that more active binding agent is released from the cell, etc.).

For example, the invention provides assays for screening candidate or test agents that bind to or modulate the activity of a member of the leukotriene pathway (or enzymatically active portion(s) thereof), as well as agents identifiable by the assays. As described above, test agents can be obtained using any of the numerous approaches in combinatorial library methods known in the art, including: biological libraries; spatially addressable parallel solid phase or solution phase libraries; synthetic library methods requiring deconvolution; the "one-bead one-compound" library method; and synthetic library methods using affinity chromatography selection. The biological library approach is limited to polypeptide libraries, while the other four approaches are applicable to polypeptide, non-peptide oligomer or small molecule libraries of compounds (Lam, K. S. *Anticancer Drug Des.,* 12:145 (1997)).

In one embodiment, to identify agents which alter the activity of a member of the leukotriene pathway (such as a FLAP binding agent, LTA4H binding agent or an agent which binds to a member of the leukotriene pathway (a "binding agent")), a cell, cell lysate, or solution containing or expressing a binding agent (e.g., 5-LO, or a leukotriene pathway member receptor, or other binding agent), or a fragment (e.g., an enzymatically active fragment) or derivative thereof, can be contacted with an agent to be tested; alternatively, the binding agent (or fragment or derivative thereof) can be contacted directly with the agent to be tested. The level (amount) of binding agent activity is assessed (either directly or indirectly), and is compared with the level of activity in a control (i.e., the level of activity in the absence of the agent to be tested). If the level of the activity in the presence of the agent differs, by an amount that is statistically significant, from the level of the activity in the absence of the agent, then the agent is an agent that alters the activity of the member of the leukotriene pathway. An increase in the level of the activity relative to a control, indicates that the agent is an agent that enhances (is an agonist of) the activity. Similarly, a decrease in the level of activity relative to a control, indicates that the agent is an agent that inhibits (is an antagonist of) the activity. In another embodiment, the level of activity in the presence of the agent to be tested, is compared with a control level that has previously been established. A level of the activity in the presence of the agent that differs from the control level by an amount that is statistically significant indicates that the agent alters the activity.

This invention further pertains to novel agents identified by the above-described screening assays. Accordingly, it is within the scope of this invention to further use an agent identified as described herein in an appropriate animal model. For example, an agent identified as described herein (e.g., a test agent that is a modulating agent, an antisense nucleic acid molecule, a specific antibody, or a polypeptide-binding agent) can be used in an animal model to determine the efficacy, toxicity, or side effects of treatment with such an agent. Alternatively, an agent identified as described herein can be used in an animal model to determine the mechanism of action of such an agent.

Furthermore, this invention pertains to uses of novel agents identified by the above-described screening assays for treatments as described herein. In addition, an agent identified as described herein can be used to alter activity of a polypeptide encoded by a FLAP nucleic acid or a LTA4H nucleic acid, or to alter expression of a FLAP nucleic acid or LTA4H nucleic acid, by contacting the polypeptide or the nucleic acid (or contacting a cell comprising the polypeptide or the nucleic acid) with the agent identified as described herein.

The present invention is now illustrated by the following Examples, which are not intended to be limiting in any way. The teachings of all references cited are incorporated herein in their entirety.

EXAMPLE 1

Identification of Gene and Haplotypes Associated with MI

A genome wide scan of 296 multiplex Icelandic families with 713 MI patients was performed as described in detail in International Application No. PCT/US2005/03312 (Publication No. WO2005/075022) incorporated herein by reference in its entirety. Through the suggestive linkage to a locus on chromosome 13q12-13 for female MI patients and early onset MI patients, and haplotype association analysis, the gene encoding the 5-lipoxygenase activating protein (FLAP) was identified, and a 4-SNP haplotype within the gene was determined to confer a near 2-fold risk of MI. Male patients showed strongest association to the at-risk haplotype. Independent confirmation of FLAP association to MI was obtained in a British cohort of patients with sporadic MI. These findings support FLAP as the first specific gene isolated that confers substantial risk of the complex trait of MI.

Linkage Analysis

A genome wide scan was performed in search of MI susceptibility genes using a framework set of around 1000 microsatellite markers. The initial linkage analysis included 713 MI patients who fulfilled the WHO MONICA research criteria (The World Health Organization MONICA Project, WHO MONICA Project Principal Investigators,. *J Clin Epidemiol*

41, 105-14 (1988)) and were clustered in 296 extended families. The linkage analysis was also repeated for early onset, male and female patients separately. Description of the number of patients and families in each analysis are provided in Table 1.

TABLE 1

Number of patients that cluster into families and the corresponding number of families used in the linkage analysis

| Phenotype | Number of patients | Number of families | Number of pairs | Genotyped relatives[a] |
|---|---|---|---|---|
| All MI patients | 713 | 296 | 863 | 1741 |
| Males | 575 | 248 | 724 | 1385 |
| Females | 140 | 56 | 108 | 366 |
| Early onset | 194 | 93 | 156 | 739 |

[a]Genotyped relatives were used to increase the information on IBD sharing among the patients in the linkage analysis None of these analyses yielded a locus of genome-wide significance. However, the most promising LOD score (LOD=2.86) was observed on chromosome 13q12-13 for female MI patients at the peak marker D13S289 (data not shown). This locus also had the most promising LOD score (LOD=2.03) for patients with early onset MI. After increasing the information on identity-by-descent sharing to over 90% by typing 14 additional microsatellite markers in a 30 centiMorgan (cM) region around D13S289, the LOD score from the female analysis dropped to 2.48 (P value=0.00036), while the highest LOD score remained at D13S289.

Microsatellite Association Study

The 7.6 Mb region that corresponds to a drop of one in LOD score in the female MI linkage analysis, contains 40 known genes (Table 2).

TABLE 2

Genes residing within the one LOD drop region of the chromosome 13q12-13 linkage peak.

| LL_Symbol | LL_gene_name |
|---|---|
| USP12L1 | ubiquitin specific protease 12 like 1 |
| RPL21 | ribosomal protein L21 |
| GTF3A | general transcription factor IIIA |
| MTIF3 | mitochondrial translational initiation factor 3 |
| PDZRN1 | PDZ domain containing ring finger 1 |
| MGC9850 | hypothetical protein MGC9850 |
| POLR1D | polymerase (RNA) I polypeptide D, 16 kDa |
| GSH1 | GS homeobox 1 |
| IPF1 | insulin promoter factor 1, homeodomain transcription factor |
| CDX2 | caudal type homeo box transcription factor 2 |
| FLT3 | fms-related tyrosine kinase 3 |
| LOC255967 | hypothetical protein LOC255967 |
| FLT1 | fms-related tyrosine kinase 1 (vascular endothelial growth factor/vascular permeability factor receptor) |
| C13orf12 | chromosome 13 open reading frame 12 |
| LOC283537 | hypothetical protein LOC283537 |
| KIAA0774 | KIAA0774 protein |
| SLC7A1 | solute carrier family 7 (cationic amino acid transporter, y+ system), member 1 |
| UBL3 | ubiquitin-like 3 |
| MGC2599 | hypothetical protein MGC2599 similar to katanin p60 subunit A 1 2599 |
| HMGB1 | high-mobility group box 1 |
| D13S106E | highly charged protein |
| ALOX5AP | arachidonate 5-lipoxygenase-activating protein |
| FLJ14834 | hypothetical protein FLJ14834 |
| MGC40178 | hypothetical protein MGC40178 |
| HSPH1 | heat shock 105 kDa/110 kDa protein 1 |
| B3GTL | beta 3-glycosyltransferase-like |
| GREAT | similar to G protein coupled receptor affecting testicular descent (*H. sapiens*) |
| LOC196549 | similar to hypothetical protein FLJ20897 |
| 13CDNA73 | hypothetical protein CG003 |
| BRCA2 | breast cancer 2, early onset |
| CG018 | hypothetical gene CG018 |
| PRO0297 | PRO0297 protein |
| LOC88523 | CG016 |
| CG012 | hypothetical gene CG012 |
| CG030 | hypothetical gene CG030 |
| CG005 | hypothetical protein from BCRA2 region |
| APRIN | androgen-induced proliferation inhibitor |
| KL | Klotho |
| STARD13 | START domain containing 13 |
| RFC3 | replication factor C (activator 1) 3, 38 kDa |

To determine which gene in this region most likely contributes to MI, 120 microsatellite markers positioned within this region were typed, and a case-control association study was performed using 802 unrelated MI patients and 837 population-based controls. The association study was also repeated for each of the three phenotypes that were used in the linkage study, i.e. early onset, male and female MI patients.

Figure 2:
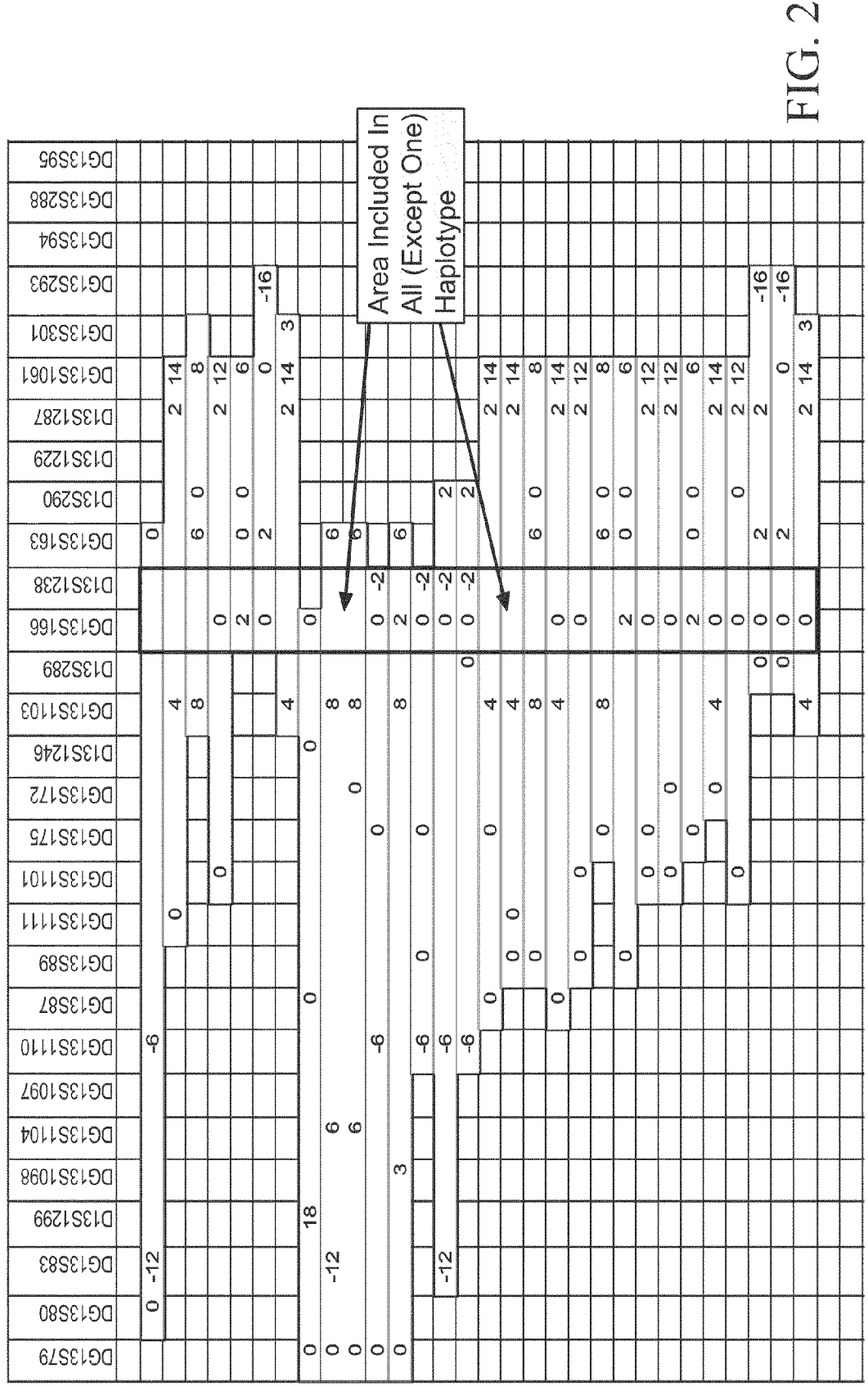
FIG. 2 shows the alleles of the markers defining the most significant microsatellite marker haplotypes. The segment defined with a black square is common to all the of most significantly associated haplotypes. The FLAP nucleic acid is located between makers DG13S166 and D13S1238. Two marker haplotype involving alleles 0 and -2 for markers DG13S166 and D13S1238, respectively, is found in excess in patients. Carrier frequency of this haploype is 27% in patients and 15.4% in controls (p-value $1\times10^{-3}$). Therefore, association analysis confirms that the most tightly MI-associated gene within the linkage peak is FLAP.
Figure 3:
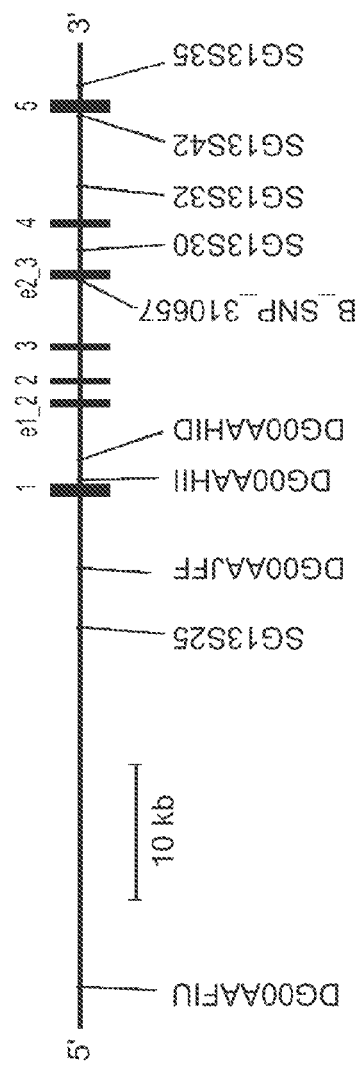
FIG. 3 shows the relative location of key SNPs and exons of the ALOX5AP/FLAP gene (exons shown in vertical rectangles). Haplotype length varies between 33 to 68 kb.

The initial association analysis was performed when the average spacing between microsatellite markers was approximately 100 kb. This analysis revealed several extended haplotypes composed of 4 and 5 microsatellite markers that were significantly associated with female MI (see FIGS. 1 and 2, and Tables 13 and 14). A region common to all these extended haplotypes, is defined by markers DG13S166 and D13S1238. This region included only one gene, the FLAP nucleic acid sequence. The two marker haplotype involving alleles 0 and −2 for markers DG13S166 and D13S1238, respectively, was found in excess in patients.

This was the first evidence that the FLAP gene might be involved in the pathogenesis of myocardial infarction.

Subsequent haplotype analysis that included more microsatellite markers (n=120) in the candidate region on chromosome 13q12-13, now with a marker density of 1 microsatellite marker per 60 kb, showed decreased significance of the original haplotype association. However, the haplotype association analysis using increased density of markers again pointed towards the FLAP gene. This analysis strongly suggested that a 300 kb region was involved in the susceptibility of myocardial infarction. The haplotype that showed association to all MI with the lowest P value (0.00009) covered a region that contains 2 known genes, including the gene encoding arachidonate 5-lipoxygenase-activating protein (FLAP) and a gene with an unknown function called highly charged protein. However, the haplotype association to female MI in this region was less significant (P value=0.005) than for all MI patients and to our surprise, the most significant haplotype association was observed for male MI patients (P value=0.000002). This male MI haplotype was the only haplotype that remained significant after adjusting for all haplotypes tested.

In view of the association results described above, FLAP was an attractive candidate and therefore efforts were focused on this gene.

Screening for Polymorphisms in FLAP and Linkage Disequilibrium Mapping

To determine whether variations within the FLAP gene significantly associate with MI and to search for causal variations, the FLAP gene was sequenced in 93 patients and 93 controls. The sequenced region covers 60 kb containing the FLAP gene, including the 5 known exons and introns and the 26 kb region 5' to the first exon and 7 kb region 3' to the fifth exon. In all, 144 SNPs were identified, of those 96 were excluded from further analysis either because of low minor allele frequency or they were completely correlated with other SNPs and thus redundant. Only one SNP was identified within a coding sequence (exon 2). This SNP did not lead to amino acid substitution. The locations of these SNPs in the NCBI human genome assembly, build 34, are listed in Table 3.

TABLE 3

Locations of all genotyped SNPs in NCBI build 34 of the human genome assembly

| SNP name | Build34 start |
| --- | --- |
| SG13S381 | 29083350 |
| SG13S366 | 29083518 |
| SG13S1 | 29086224 |
| SG13S2 | 29087473 |
| SG13S367 | 29088090 |
| SG13S10 | 29088473 |
| SG13S3 | 29089044 |
| SG13S368 | 29089886 |
| SG13S4 | 29090997 |
| SG13S5 | 29091307 |
| SG13S90 | 29091780 |
| SG13S6 | 29092536 |
| SG13S371 | 29093964 |
| SG13S372 | 29094259 |
| SG13S373 | 29096688 |
| SG13S375 | 29096874 |
| SG13S376 | 29096962 |
| SG13S25 | 29097553 |
| SG13S377 | 29101965 |
| SG13S100 | 29104271 |
| SG13S95 | 29106329 |
| SG13S191 | 29107830 |
| SG13S106 | 29108579 |
| SG13S114 | 29110096 |
| SG13S121 | 29112174 |
| SG13S122 | 29112264 |
| SG13S43 | 29112455 |
| SG13S192 | 29116308 |
| SG13S88 | 29116401 |
| SG13S137 | 29118118 |
| SG13S86 | 29118815 |
| SG13S87 | 29118873 |
| SG13S39 | 29119740 |
| SG13S26 | 29122253 |
| SG13S27 | 29122283 |
| SG13S29 | 29123643 |
| SG13S89 | 29124441 |
| SG13S96 | 29124906 |
| SG13S30 | 29125840 |
| SG13S97 | 29129139 |
| SG13S32 | 29130547 |
| SG13S41 | 29134045 |
| SG13S42 | 29135877 |
| SG13S34 | 29137100 |
| SG13S35 | 29138117 |
| SG13S181 | 29138633 |
| SG13S184 | 29139435 |
| SG13S188 | 29140805 |

In addition to the SNPs, a polymorphism consisting of a monopolymer A repeat that has been described in the FLAP promoter region was typed (Koshino, T. et al., *Mol Cell Biol Res Commun* 2, 32-5 (1999)).

Figure 6:
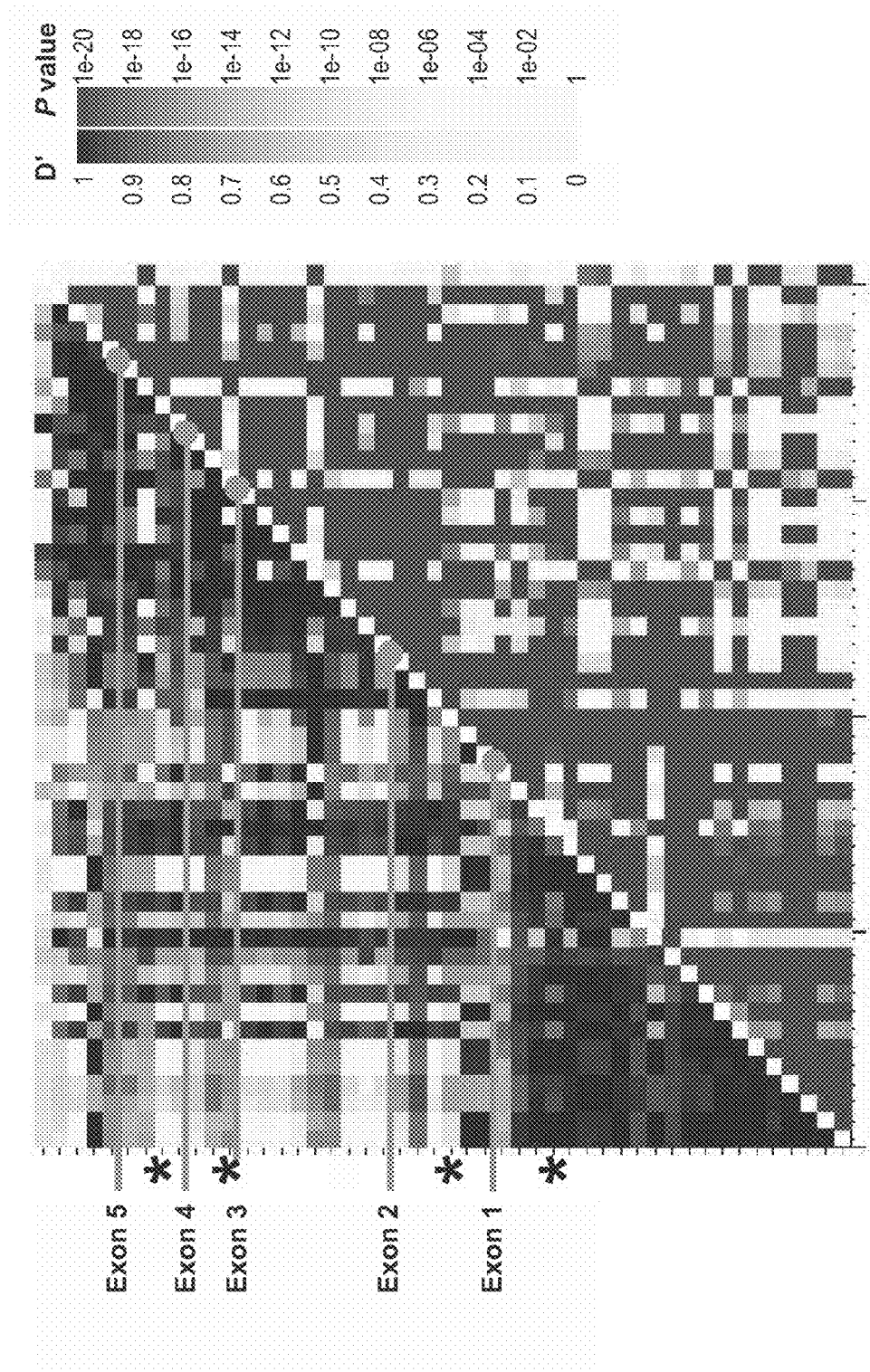
FIG. 6 shows a pairwise linkage disequilibrium (LD) between SNPs in a 60 kb region encompassing FLAP. The markers are plotted equidistantly. Two measures of LD are shown: D' in the upper left triangle and P values in the lower right triangle. Shaded lines indicate the positions of the exons of FLAP and the stars indicate the location of the markers of the at-risk haplotype A4. Scales for the LD strength are provided for both measures to the right.

The linkage disequilibrium (LD) block structure defined by the 48 SNPs that were selected for further genotyping is shown in FIG. 6. A strong LD was detected across the FLAP region, although it appears that at least one recombination may have occurred dividing the region into two strongly correlated LD blocks.

Haplotype Association to MI

To perform a case-control association study the 48 selected SNPs and the monopolymer A repeat marker were genotyped in a set of 779 unrelated MI patients and 628 population-based controls. Each of the 49 markers were tested individually for association to the disease. Three SNPs, one located 3 kb upstream of the first exon and the other two 1 and 3 kb downstream of the first exon, showed nominally significant association to MI (Table 4).

TABLE 4

SNP allelic association in the MI cohort

| Phenotype | Marker | Allele | P value | RR | # Pat. | % Pat. | # Ctrl | % Ctrl |
|---|---|---|---|---|---|---|---|---|
| All patients | SG13S106 | G | 0.0044 | 1.29 | 681 | 72.0 | 530 | 66.6 |
| | SG13S100 | A | 0.020 | 1.29 | 388 | 69.6 | 377 | 63.9 |
| | SG13S114 | T | 0.021 | 1.21 | 764 | 70.0 | 602 | 65.8 |
| Males | SG13S106 | G | 0.0037 | 1.35 | 422 | 72.9 | 530 | 66.6 |
| | SG13S100 | A | 0.0099 | 1.36 | 292 | 70.7 | 377 | 63.9 |
| | SG13S114 | T | 0.026 | 1.24 | 477 | 70.4 | 602 | 65.8 |
| Early onset | SG13S100 | A | 0.0440 | 1.43 | 99 | 71.7 | 377 | 63.9 |

Nominally significant SNP association with corresponding number of patients (# Pat.) and controls (#Ctrl). RR refers to relative risk.

However, after adjusting for the number of markers tested, these results were not significant. A search was then conducted for haplotypes that show association to the disease using the same cohorts. For computational reasons, the search was limited to haplotype combinations constructed out of two, three or four SNPs and only haplotypes that were in excess in the patients were tested. The resulting P values were adjusted for all the haplotypes tested by randomizing the patients and controls (see Methods).

Several haplotypes were found that were significantly associated to the disease with an adjusted P value less that 0.05 (Table 5).

TABLE 5

SNP haplotypes that significantly associate with Icelandic MI patients

| SG13S4 | SG13S6 | SG13S372 | SG13S25 | SG13S377 | SG13S100 | SG13S95 | SG13S114 | SG13S192 | SG13S137 | SG13S86 | SG13S87 | SG13S39 |
|---|---|---|---|---|---|---|---|---|---|---|---|---|
| | | | | G | | | T | | | | | |
| | | | | G | | | T | | | | A | |
| | | | | G | | | T | | | | | |
| | | | | G | A | | | | | | A | |
| | | | | G | | T | T | | | | | |
| | | | | G | | | T | | | G | | |
| | | | | G | A | | | | | | | |
| | | | | G | A | | | | | | | |
| | | | | G | | | T | | | | | |
| | | | | G | | | T | | | | | |
| | G | | | | | T | T | | | | | |
| | | | | G | A | | | | | G | | |
| | | | | G | | | T | A | | | | |
| | | | | G | | | T | | | | | |
| | | G | | | | | T | | | | | |
| | | G | | G | | | T | | | | | |
| G | | | | | | | | | | | | |
| G | | | G | | A | | | | | | | |
| | | | | G | A | | | | | | | |
| G | | | | G | A | | | | | | A | |
| | | | G | | A | | | | | | | |
| G | | | | | | | T | | | | A | |
| | | | | G | A | | | A | | | | |
| | | | | G | | | T | | | | | G |
| G | | | | G | A | | | | | | | |
| G | | | | | | | T | | | | | |
| | | | | G | A | | | | | | | |
| G | | | | | | | T | | | | | |
| G | | | G | | A | | | | | | | |
| | | | | G | A | | | | A | | | |
| | | | | G | | | T | | A | | | |
| | | | G | | A | | | | A | | | |
| | | | | G | | | T | | | C | | |
| | | | | G | | | T | | | | | |
| | | | | G | | | T | | | C | | |
| | | | G | G | A | | | | | | | |
| | | G | | | | | T | | | | | |
| | | G | | | | | T | | | G | | |
| | | G | | | A | | | | | | | |
| | | | | G | A | | | | | | | G |
| C | G | | | | A | | | | | | | |
| | G | | | | | | T | A | | | | |
| | G | | | | A | | | | | | | |
| | G | | | | | | T | | | | | |
| | | | G | | | | T | | | | | |
| | G | G | | | A | | | | | | | |
| | G | | | G | A | | | | A | | | |

TABLE 5-continued

SNP haplotypes that significantly associate with Icelandic MI patients

| SG13S27 | SG13S89 | SG13S96 | SG13S32 | SG13S41 | SG13S42 | SG13S34 | SG13S188 | P value[a] | P value[b] | Pat. frq | Ctrl. frq | RR | D'[c] |
|---|---|---|---|---|---|---|---|---|---|---|---|---|---|
|  | G |  | A |  |  |  |  | 0.0000023 | 0.005 | 0.158 | 0.095 | 1.80 | 1.00 |
|  |  |  | A |  |  |  |  | 0.0000030 | 0.006 | 0.158 | 0.095 | 1.78 | 1.00 |
|  |  |  | A |  |  | T |  | 0.0000032 | 0.007 | 0.157 | 0.094 | 1.79 | 1.00 |
|  |  |  | A |  |  |  |  | 0.0000046 | 0.012 | 0.158 | 0.083 | 2.07 | 0.89 |
|  |  |  | A |  |  |  |  | 0.0000047 | 0.012 | 0.154 | 0.093 | 1.78 | 1.00 |
|  |  |  | A |  |  |  |  | 0.0000055 | 0.015 | 0.147 | 0.087 | 1.81 | 1.00 |
|  |  |  | A |  |  | T |  | 0.0000061 | 0.017 | 0.157 | 0.083 | 2.07 | 0.89 |
|  | G |  | A |  |  |  |  | 0.0000063 | 0.017 | 0.157 | 0.084 | 2.04 | 0.89 |
|  |  |  | A |  |  |  |  | 0.0000070 | 0.021 | 0.157 | 0.096 | 1.76 | 1.00 |
|  |  | A | A |  |  |  |  | 0.0000075 | 0.022 | 0.149 | 0.089 | 1.78 | 1.00 |
|  |  |  | A |  |  |  |  | 0.0000083 | 0.024 | 0.208 | 0.139 | 1.62 | 0.99 |
|  |  |  | A |  |  |  |  | 0.0000084 | 0.026 | 0.145 | 0.074 | 2.14 | 0.88 |
|  |  |  | A |  |  |  |  | 0.0000084 | 0.026 | 0.139 | 0.082 | 1.82 | 1.00 |
| G |  |  | A |  |  |  |  | 0.0000091 | 0.028 | 0.156 | 0.096 | 1.75 | 1.00 |
|  |  |  | A |  |  | T |  | 0.0000094 | 0.028 | 0.210 | 0.141 | 1.61 | 0.99 |
|  |  |  | A |  |  |  |  | 0.0000100 | 0.028 | 0.156 | 0.096 | 1.74 | 1.00 |
|  |  |  | A |  |  |  | A | 0.0000101 | 0.028 | 0.215 | 0.133 | 1.80 | 0.81 |
|  |  |  | A |  |  |  |  | 0.0000105 | 0.028 | 0.157 | 0.084 | 2.03 | 0.89 |
|  |  |  | A |  |  |  |  | 0.0000108 | 0.029 | 0.214 | 0.133 | 1.78 | 0.81 |
|  |  | A | A |  |  |  |  | 0.0000110 | 0.030 | 0.146 | 0.075 | 2.10 | 0.88 |
|  |  |  | A |  |  |  |  | 0.0000112 | 0.030 | 0.212 | 0.144 | 1.60 | 1.00 |
|  |  |  |  |  |  | T |  | 0.0000113 | 0.030 | 0.151 | 0.081 | 2.03 | 0.78 |
|  |  |  | A |  |  |  |  | 0.0000118 | 0.031 | 0.156 | 0.096 | 1.73 | 1.00 |
|  |  |  | A |  |  | T |  | 0.0000126 | 0.034 | 0.212 | 0.131 | 1.79 | 0.79 |
|  | G |  | A |  |  |  |  | 0.0000129 | 0.035 | 0.211 | 0.144 | 1.59 | 1.00 |
| G |  |  | A |  |  |  |  | 0.0000134 | 0.035 | 0.156 | 0.084 | 2.01 | 0.89 |
|  |  |  | A |  |  |  |  | 0.0000136 | 0.036 | 0.211 | 0.143 | 1.60 | 1.00 |
|  |  |  | A |  |  |  |  | 0.0000137 | 0.036 | 0.156 | 0.085 | 2.00 | 0.89 |
|  |  | A |  |  |  |  |  | 0.0000148 | 0.037 | 0.151 | 0.081 | 2.01 | 0.78 |
|  |  |  |  |  |  | T |  | 0.0000150 | 0.037 | 0.160 | 0.099 | 1.73 | 0.87 |
|  |  |  | A |  |  |  |  | 0.0000150 | 0.037 | 0.130 | 0.066 | 2.13 | 0.90 |
|  |  |  |  |  |  | T |  | 0.0000154 | 0.039 | 0.152 | 0.094 | 1.73 | 0.93 |
|  |  |  | A |  | A |  |  | 0.0000154 | 0.040 | 0.155 | 0.097 | 1.70 | 1.00 |
|  |  |  | A |  |  |  |  | 0.0000157 | 0.040 | 0.141 | 0.085 | 1.76 | 1.00 |
|  |  |  | A |  |  |  |  | 0.0000158 | 0.040 | 0.152 | 0.084 | 1.94 | 0.90 |
| G |  |  | A |  |  |  |  | 0.0000163 | 0.040 | 0.210 | 0.143 | 1.59 | 0.99 |
|  |  |  | A |  |  |  |  | 0.0000166 | 0.041 | 0.200 | 0.134 | 1.61 | 0.92 |
|  | G |  | A |  |  |  |  | 0.0000168 | 0.042 | 0.213 | 0.133 | 1.76 | 0.81 |
|  |  |  | A |  |  |  |  | 0.0000168 | 0.042 | 0.156 | 0.084 | 2.00 | 0.89 |
|  |  |  | A |  |  |  |  | 0.0000171 | 0.042 | 0.211 | 0.136 | 1.70 | 0.81 |
|  |  |  | A |  |  |  |  | 0.0000183 | 0.043 | 0.192 | 0.128 | 1.62 | 0.85 |
|  |  |  | A |  |  |  |  | 0.0000184 | 0.043 | 0.212 | 0.132 | 1.77 | 0.81 |
|  |  |  |  | A |  | T |  | 0.0000193 | 0.046 | 0.328 | 0.251 | 1.46 | 0.99 |
| G |  |  |  |  |  | T |  | 0.0000194 | 0.046 | 0.175 | 0.115 | 1.64 | 0.98 |
|  |  |  | A |  |  |  |  | 0.0000202 | 0.048 | 0.210 | 0.136 | 1.70 | 0.81 |
|  |  |  |  |  |  |  |  | 0.0000209 | 0.049 | 0.151 | 0.082 | 2.00 | 0.76 |

[a] Single test P values.
[b] P values adjusted for all the SNP haplotypes tested.
[c] Measure of correlation with Haplotype A4.

The most significant association was observed for a four SNP haplotype spanning 33 kb, including the first four exons of the gene, with a nominal P value of 0.0000023 and an adjusted P value of 0.005. This haplotype, labelled A4, has haplotype frequency of 15.8% (carrier frequency 30.3%) in patients versus 9.5% (carrier frequency 17.9%) in controls (Table 6).

TABLE 6

Association of the A4 haplotype to MI, Stroke and PAOD

| Phenotype (n) | Frq. Pat. | RR | PAR | P-value | P-value[a] |
|---|---|---|---|---|---|
| MI (779) | 0.158 | 1.80 | 0.135 | 0.0000023 | 0.005 |
| Males (486) | 0.169 | 1.95 | 0.158 | 0.00000091 | ND[b] |
| Females (293) | 0.138 | 1.53 | 0.094 | 0.0098 | ND |
| Early onset (358) | 0.138 | 1.53 | 0.094 | 0.0058 | ND |
| Stroke (702)[c] | 0.149 | 1.67 | 0.116 | 0.000095 | ND |
| Males (373) | 0.156 | 1.76 | 0.131 | 0.00018 | ND |
| Females (329) | 0.141 | 1.55 | 0.098 | 0.0074 | ND |
| PAOD (577)[c] | 0.122 | 1.31 | 0.056 | 0.061 | ND |
| Males (356) | 0.126 | 1.36 | 0.065 | 0.057 | ND |
| Females (221) | 0.114 | 1.22 | 0.041 | 0.31 | ND |

[a] P value adjusted for the number of haplotypes tested.
[b] Not done.
[c] Excluding known cases of MI. Shown is the FLAP A4 haplotype and corresponding number of patients (n), haplotype frequency in patients (Frq. pat.), relative risk (RR), population attributed risk (PAR) and P values.
The A4 haplotype is defined by the following SNPs: SG13S25, SG13S114, SG13S89 and SG13S32 (Table 5). The same controls (n = 628) are used for the association analysis in MI, stroke and PAOD as well as for the male, female and early onset analysis. The A4 haplotype frequency in the control cohort is 0.095.

The relative risk conferred by The A4 haplotype compared to other haplotypes constructed out of the same SNPs, assuming a multiplicative model, was 1.8 and the corresponding population attributable risk (PAR) was 13.5%. As shown in Table 6, the A4 haplotype was observed in higher frequency in male patients (carrier frequency 30.9%) than in female patients (carrier frequency 25.7%). All the other haplotypes that were significantly associated with an adjusted P value less than 0.05, were highly correlated with the A4 haplotype and should be considered variants of that haplotype (Table 5). Table 6 shows the results of the haplotype A4 association study using 779 MI patients, 702 stroke patients, 577 PAOD patients and 628 controls. First and second degree relatives were excluded from the patient cohorts. All known cases of MI were removed from the stroke and PAOD cohorts before testing for association. A significant association of the A4 haplotype to stroke was observed, with a relative risk of 1.67 (P value=0.000095). In addition, it was determined whether the A4 haplotype was primarily associated with a particular sub-phenotype of stroke, and found that both ischemic and hemorrhagic stroke were significantly associated with the A4 haplotype (Table 22, below).

(15-16%). The haplotypes in series B and A are strongly correlated, i.e. the haplotypes in B define a subset of the haplotypes in A. Hence, haplotypes B are more specific than A. Haplotypes A are however more sensitive, i.e. they capture more individuals with the putative mutation, as is observed in the population attributable risk which is less for B than for A. Furthermore, these haplotypes show similar risk ratios and allelic frequency for early-onset patients (defined as onset of first MI before the age of 55) and for both gender. In addition, analyzing various groups of patients with known risk factors, such as hypertension, high cholesterol, smoking and diabetes, did not reveal any significant correlation with these haplotypes, indicating that the haplotypes in the FLAP gene represent an independent genetic susceptibility factor for MI.

TABLE 7

The selected SNP haplotypes and the corresponding p-values

|    | p-val    | RR   | #aff | aff. frq. | carr. frq. | #con | con. frq. | PAR  | SG13S99 | SG13S25 |
|----|----------|------|------|-----------|------------|------|-----------|------|---------|---------|
| B4 | 4.80E−05 | 2.08 | 903  | 0.106     | 0.2        | 619  | 0.054     | 0.11 |         | G       |
| B5 | 2.40E−05 | 2.2  | 910  | 0.101     | 0.19       | 623  | 0.049     | 0.11 | T       | G       |
| B6 | 1.80E−06 | 2.22 | 913  | 0.131     | 0.24       | 623  | 0.063     | 0.14 | T       | G       |
| A4 | 5.10E−06 | 1.81 | 919  | 0.159     | 0.29       | 623  | 0.095     | 0.14 |         | G       |
| A5 | 2.60E−06 | 1.91 | 920  | 0.15      | 0.28       | 624  | 0.085     | 0.14 | T       | G       |

|    | SG13S377 | SG13S106 | SG13S114 | SG13S89 | SG13S30 | SG13S32 | SG13S42 | SG13S35 |
|----|----------|----------|----------|---------|---------|---------|---------|---------|
| B4 |          | G        |          |         | G       |         | A       |         |
| B5 |          | G        |          |         | G       |         | A       |         |
| B6 | G        | G        |          |         |         | A       |         | G       |
| A4 |          |          | T        | G       |         | A       |         |         |
| A5 |          |          | T        | G       |         | A       |         |         |

Relative risk (RR),
number of patients (#aff),
allelic frequency in patients (aff. frq.),
carrier frequency in patients (carr. frq.),
number of controls (#con),
allelic frequency in controls (con. frq.),
population attributable risk (PAR).
The patients used for this analysis were all unrelated within 4 meioses.

More Variants of Haplotype A4

Two correlated series of SNP haplotypes were observed in excess in patients, denoted as A and B in Table 7. The length of the haplotypes varies between 33 and 69 Kb, and the haplotypes cover one or two blocks of linkage disequilibrium. Both series of haplotypes contain the common allele G of the SNP SG13S25. All haplotypes in the A series contain the SNP SG13S114, while all haplotypes in the B series contain the SNP SG13S106. In the B series, the haplotypes B4, B5, and B6 have a relative risk (RR) greater than 2 and with allelic frequencies above 10%. The haplotypes in A series have slightly lower RR and lower p-values, but higher frequency Haplotype Association to Female MI Before we had typed all the SNPs that eventually lead to the identification of A4 haplotype we performed a haplotype association analysis that included 437 female MI patients, 1049 male MI patients, and 811 controls that had been genotyped with several SNPs and 3 microsatellite markers. These markers were all located within 300 kb region encompassing the FLAP gene. In a case-control study of the MI patients using these data, several haplotypes were found, that were significantly over-represented in the female MI patients compared to controls (see Table 8). All these haplotypes were highly correlated with each other.

TABLE 8 haplotypes in the FLAP region (FLAP and flanking nucleotide sequences) that were associated with female MI.

| SG13S421 | SG13S418 | SG13S419 | SG13S420 | DG13S166 | SG13S106 | SG13S114 | SG13S121 | SG13S122 | SG13S88 | SG13S181 |
|----------|----------|----------|----------|----------|----------|----------|----------|----------|---------|----------|
|          |          | C        | T        | 0        |          |          |          |          |         |          |
|          |          | C        | T        | 0        |          | T        |          | A        |         | T        |
|          |          | C        | T        | 0        |          | T        |          |          |         | T        |
|          |          | C        | T        | 0        |          | T        | G        |          |         | T        |
|          |          | C        | T        | 0        |          | T        |          |          |         | T        |
|          | A        | C        | T        | 0        |          | T        |          |          |         | T        |

TABLE 8-continued haplotypes in the FLAP region (FLAP and flanking nucleotide sequences) that were associated with female MI.

|   |   |   | C |   | T | 0 |   | T |   | A | T |   |
|---|---|---|---|---|---|---|---|---|---|---|---|---|
|   |   |   | C |   | T | 0 |   | T |   |   | T | G |
|   |   |   | C |   | T | 0 |   |   | G |   | T |   |
|   |   |   | C |   | T | 0 |   |   | G |   | T |   |
|   |   |   | C |   | T | 0 | G |   |   |   | T |   |
|   |   |   | C |   | T | 0 |   |   |   | A | T |   |
|   |   |   | C |   | T | 0 |   |   |   | A | T |   |
|   |   |   | C |   | T | 0 |   |   | G | A | T |   |
| A |   |   | C |   | T | 0 |   |   | G |   | T |   |
| A |   |   | C |   | T | 0 |   |   |   |   | T |   |
| A |   |   | C |   | T | 0 |   | T |   |   | T |   |
|   |   |   | C | A | T | 0 |   |   | G |   | T |   |
| A |   |   | C |   | T | 0 |   |   |   | A | T |   |
| A |   |   | C | A | T | 0 |   |   |   |   | T |   |

| SG13S184 | D13S1238 | DG13S2605 | p-val | N_aff | aff. frq | N_ctrl | ctrl. frq | rel_risk | PAR | info |
|---|---|---|---|---|---|---|---|---|---|---|
| G | −2 |   | 1.30E−05 | 455 | 0.108 | 811 | 0.048 | 2.4 | 0.122 | 0.615 |
|   | −2 | 0 | 7.61E−06 | 455 | 0.065 | 812 | 0.02 | 3.45 | 0.091 | 0.615 |
|   | −2 | 0 | 8.82E−06 | 455 | 0.065 | 812 | 0.02 | 3.47 | 0.092 | 0.602 |
|   | −2 | 0 | 9.31E−06 | 455 | 0.065 | 812 | 0.02 | 3.39 | 0.089 | 0.611 |
| G | −2 | 0 | 6.91E−06 | 455 | 0.063 | 812 | 0.019 | 3.54 | 0.09 | 0.624 |
|   | −2 | 0 | 9.76E−06 | 455 | 0.063 | 812 | 0.019 | 3.51 | 0.089 | 0.606 |
| G | −2 |   | 1.09E−05 | 455 | 0.063 | 811 | 0.019 | 3.41 | 0.086 | 0.618 |
|   | −2 | 0 | 1.10E−05 | 455 | 0.063 | 812 | 0.019 | 3.44 | 0.087 | 0.611 |
| G | −2 | 0 | 1.11E−05 | 455 | 0.063 | 812 | 0.018 | 3.56 | 0.086 | 0.589 |
| G | −2 |   | 1.22E−05 | 455 | 0.063 | 811 | 0.018 | 3.6 | 0.087 | 0.577 |
| G | −2 | 0 | 1.26E−05 | 455 | 0.063 | 812 | 0.02 | 3.35 | 0.088 | 0.629 |
| G | −2 | 0 | 8.59E−06 | 455 | 0.062 | 812 | 0.018 | 3.53 | 0.085 | 0.62 |
| G | −2 |   | 1.20E−05 | 455 | 0.062 | 811 | 0.019 | 3.42 | 0.086 | 0.617 |
| G | −2 |   | 1.21E−05 | 455 | 0.062 | 811 | 0.019 | 3.43 | 0.086 | 0.619 |
| G | −2 |   | 7.93E−06 | 455 | 0.061 | 811 | 0.016 | 3.95 | 0.088 | 0.562 |
| G | −2 |   | 1.09E−05 | 455 | 0.061 | 811 | 0.017 | 3.85 | 0.09 | 0.56 |
| G | −2 |   | 5.00E−06 | 455 | 0.06 | 811 | 0.015 | 4.11 | 0.087 | 0.576 |
| G | −2 |   | 1.31E−05 | 455 | 0.06 | 811 | 0.017 | 3.66 | 0.085 | 0.586 |
| G | −2 |   | 8.53E−06 | 455 | 0.059 | 811 | 0.016 | 3.85 | 0.085 | 0.593 |
| G | −2 |   | 9.63E−06 | 455 | 0.058 | 811 | 0.015 | 4.03 | 0.085 | 0.565 |

Table 9 shows two haplotypes that are representative of these female MI risk haplotypes. The relative risk of these haplotypes were 2.4 and 4, and they were carried by 23% and 13% of female MI patients, respectively.

Table 10 shows that these same haplotypes were also over-represented in male MI patients compared to controls, although with lower relative risk. It should be noted that after typing and analysing more SNPs in the FLAP region.

TABLE 9

Two representative variants of the female MI "at risk" haplotypes

|  | SG13S418 | SG13S420 | DG13S166 | SG13S114 | SG13S88 | SG13S184 | D13S1238 | p-val |
|---|---|---|---|---|---|---|---|---|
| Female MI | C | T | 0 | T | T | G | −2 | 6.38E−06 |
|  | C | T | 0 |  |  | G | −2 | 2.74E−05 |

|  | N_aff | aff. frq | N_ctrl | ctrl. frq | rel_risk | PAR | info |
|---|---|---|---|---|---|---|---|
| Female MI | 454 | 0.059 | 809 | 0.015 | 4.05 | 0.086 | 0.577 |
|  | 447 | 0.106 | 809 | 0.048 | 2.33 | 0.116 | 0.623 |

P-val: p-value for the association.
N_aff: Number of patients used in the analysis.
Aff. frq: haplotype frequency in patients.
N_ctrl: number of controls used in the analysis.
Ctrl. frq: Haplotype frequency in controls.
Rel_risk: Relative risk of the haplotype.
PAR: population attributable risk. Info: information content.

TABLE 10

The frequencies of the female MI "at risk" haplotypes in male patients vs controls.

| | SG13S418 | SG13S420 | DG13S166 | SG13S114 | SG13S88 | SG13S184 | D13S1238 |
|---|---|---|---|---|---|---|---|
| Male MI | C | T | 0 | T | T | G | −2 |
| | C | T | 0 | | | G | −2 |

| | p-val | N_aff | aff. frq | N_ctrl | ctrl. frq | rel_risk | PAR | info |
|---|---|---|---|---|---|---|---|---|
| Male MI | 3.37E−01 | 1087 | 0.027 | 809 | 0.021 | 1.32 | 0.013 | 0.577 |
| | 5.39E−01 | 1087 | 0.056 | 809 | 0.05 | 1.13 | 0.013 | 0.568 |

P-val: p-value for the association.
N_aff: Number of patients used in the analysis.
Aff. frq: haplotype frequency in patients.
N_ctrl: number of controls used in the analysis.
Ctrl. frq: Haplotype frequency in controls.
Rel_risk: Relative risk of the haplotype.
PAR: population attributable risk. Info: information content.

TABLE 11

The marker map for chromosome 13 used in the linkage analysis.

| Location (cM) | Marker |
|---|---|
| 6 | D13S175 |
| 9.8 | D13S1243 |
| 13.5 | D13S1304 |
| 17.2 | D13S217 |
| 21.5 | D13S289 |
| 25.1 | D13S171 |
| 28.9 | D13S219 |
| 32.9 | D13S218 |
| 38.3 | D13S263 |
| 42.8 | D13S326 |
| 45.6 | D13S153 |
| 49.4 | D13S1320 |
| 52.6 | D13S1296 |
| 55.9 | D13S156 |
| 59.8 | D13S1306 |
| 63.9 | D13S170 |
| 68.7 | D13S265 |
| 73 | D13S167 |
| 76.3 | D13S1241 |
| 79.5 | D13S1298 |
| 81.6 | D13S1267 |
| 84.7 | D13S1256 |
| 85.1 | D13S158 |
| 87 | D13S274 |
| 93.5 | D13S173 |
| 96.7 | D13S778 |
| 102.7 | D13S1315 |
| 110.6 | D13S285 |
| 115 | D13S293 |

TABLE 12

Marker Map for the second step of Linkage Analysis

| Location (cM) | Marker |
|---|---|
| 1.758 | D13S175 |
| 9.235 | D13S787 |
| 11.565 | D13S1243 |
| 16.898 | D13S221 |
| 17.454 | D13S1304 |
| 18.011 | D13S1254 |
| 18.59 | D13S625 |
| 19.308 | D13S1244 |
| 19.768 | D13S243 |
| 22.234 | D13S1250 |
| 22.642 | D13S1242 |
| 22.879 | D13S217 |
| 25.013 | D13S1299 |
| 28.136 | D13S289 |
| 28.678 | D13S290 |
| 29.134 | D13S1287 |
| 30.073 | D13S260 |
| 31.98 | D13S171 |
| 32.859 | D13S267 |
| 33.069 | D13S1293 |
| 33.07 | D13S620 |
| 34.131 | D13S220 |
| 36.427 | D13S219 |
| 39.458 | D13S1808 |
| 40.441 | D13S218 |
| 41.113 | D13S1288 |
| 41.996 | D13S1253 |
| 42.585 | D13S1248 |
| 44.288 | D13S1233 |
| 44.377 | D13S263 |
| 45.535 | D13S325 |
| 45.536 | D13S1270 |
| 45.537 | D13S1276 |
| 49.149 | D13S326 |
| 49.532 | D13S1272 |
| 52.421 | D13S168 |
| 52.674 | D13S287 |
| 60.536 | D13S1320 |
| 64.272 | D13S1296 |
| 71.287 | D13S156 |
| 76.828 | D13S1306 |
| 77.86 | D13S170 |
| 82.828 | D13S265 |
| 91.199 | D13S1241 |
| 93.863 | D13S1298 |
| 97.735 | D13S779 |
| 100.547 | D13S1256 |
| 102.277 | D13S274 |
| 111.885 | D13S173 |
| 112.198 | D13S796 |
| 115.619 | D13S778 |
| 119.036 | D13S1315 |
| 126.898 | D13S285 |
| 131.962 | D13S293 |

Table 13 shows the exons with positions that encode the FLAP protein, markers, polymorphisms and SNPs identified within the genomic sequence by the methods described herein.

| NCBI build34; start on chr. 13 (bp) | NCBI build34; stop on chr. 13 (bp) | SNP/ marker/ exon name | alias1 | alias2 | public SNP | Variation | minor allele | minor allele frequency (%) | start position in SEQ ID NO: 1 | end position in SEQ ID NO: 1 |
|---|---|---|---|---|---|---|---|---|---|---|
| 28932432 | 28932432 | SG13S421 | | DG00AAFQR | rs1556428 | A/G | G | 10.32 | 432 | 432 |
| 28960356 | 28960356 | SG13S417 | | SNP13B_R1028729 | rs1028729 | C/T | G | 30.46 | 28356 | 28356 |
| 28965803 | 28965803 | SG13S418 | | SNP13B_Y1323898 | rs1323898 | A/G | T | 37.38 | 33803 | 33803 |
| 28974627 | 28974627 | SG13S44 | | | | A/G | G | 0.545 | 42627 | 42627 |
| 28975101 | 28975101 | SG13S45 | | | | C/G | G | 1.111 | 43101 | 43101 |
| 28975315 | 28975315 | SG13S46 | | | | A/G | G | 0.328 | 43315 | 43315 |
| 28975353 | 28975353 | SG13S50 | | | | C/T | C | 0.495 | 43353 | 43353 |
| 28975774 | 28975774 | SG13S52 | | | | A/G | A | 6.993 | 43774 | 43774 |
| 28985244 | 28985244 | SG13S53 | | | rs1408167 | A/C | C | 30.876 | 53244 | 53244 |
| 28985303 | 28985303 | SG13S55 | | | rs1408169 | A/G | G | 6.731 | 53303 | 53303 |
| 28985423 | 28985423 | SG13S56 | | | | G/T | T | 0.353 | 53423 | 53423 |
| 28985734 | 28985734 | SG13S57 | | | rs6490471 | C/T | C | 31.356 | 53734 | 53734 |
| 28985902 | 28985902 | SG13S58 | | | rs6490472 | A/G | A | 30.935 | 53902 | 53902 |
| 29003869 | 29003869 | SG13S59 | | | | C/G | G | 5.492 | 71869 | 71869 |
| 29004696 | 29004696 | SG13S60 | | | | A/G | A | 1.812 | 72696 | 72696 |
| 29007670 | 29007670 | SG13S419 | | SNP13B_K912392 | rs912392 | C/T | G | 35.00 | 75670 | 75670 |
| 29015410 | 29015410 | SG13S61 | | | | C/T | C | 1.314 | 83410 | 83410 |
| 29025792 | 29025792 | SG13S62 | | | | C/T | T | 3.521 | 93792 | 93792 |
| 29026202 | 29026202 | SG13S63 | | | rs7997114 | A/G | A | 30.031 | 94202 | 94202 |
| 29026668 | 29026668 | SG13S64 | | | | A/G | A | 1.724 | 94668 | 94668 |
| 29038707 | 29038707 | SG13S65 | | | | A/G | A | 0.369 | 106707 | 106707 |
| 29042180 | 29042180 | SG13S420 | | DG00AAFIV | rs2248564 | A/T | A | 13.66 | 110180 | 110180 |
| 29049355 | 29049355 | SG13S66 | | | | A/G | A | 20.779 | 117355 | 117355 |
| 29049446 | 29049446 | SG13S67 | | | | C/T | T | 5.965 | 117446 | 117446 |
| 29050416 | 29050416 | SG13S69 | | | | A/C | A | 16.923 | 118416 | 118416 |
| 29059348 | 29059348 | SG13S70 | | | | A/G | A | 34.364 | 127348 | 127348 |
| 29059383 | 29059383 | SG13S71 | | | | A/G | A | 8.537 | 127383 | 127383 |
| 29059402 | 29059402 | SG13S72 | | | | G/T | T | 25.536 | 127402 | 127402 |
| 29063702 | 29063949 | D13S289 | | | | | | | 131702 | 131949 |
| 29064359 | 29064753 | DG13S166 | | | | | | | 132359 | 132753 |
| 29066272 | 29066272 | SG13S73 | | | | A/G | A | 37.302 | 134272 | 134272 |
| 29070551 | 29070551 | SG13S99 | SNP_13_Y1323892 | DG00AAFIU | rs1323892 | C/T | C | 6.25 | 138551 | 138551 |
| 29081983 | 29081983 | SG13S382 | FLA267479 | | | A/G | A | 0.49 | 149983 | 149983 |
| 29082200 | 29082200 | SG13S383 | FLA267696 | | | A/G | A | 14.08 | 150200 | 150200 |
| 29082357 | 29082357 | SG13S384 | FLA267853 | | | A/G | G | 0.62 | 150357 | 150357 |
| 29083350 | 29083350 | SG13S381 | FLA268846 | DG00AAJER | | C/G | G | 14.01 | 151350 | 151350 |
| 29083518 | 29083518 | SG13S366 | FLA269014 | DG00AAJES | rs4312166 | A/G | T | 0.58 | 151518 | 151518 |
| 29085102 | 29085102 | SG13S385 | FLA270742 | | | C/T | C | 30.21 | 153102 | 153102 |
| 29085190 | 29085190 | SG13S386 | FLA270830 | | | A/G | A | 10.95 | 153190 | 153190 |
| 29086224 | 29086224 | SG13S1 | FLA271864 | | | G/T | G | 30.00 | 154224 | 154224 |
| 29087473 | 29087473 | SG13S2 | FLA273371 | | | A/G | A | 27.95 | 155473 | 155473 |
| 29088090 | 29088090 | SG13S367 | FLA273988 | DG00AAJEU | rs4474551 | A/G | G | 2.41 | 156090 | 156090 |
| 29088186 | 29088186 | SG13S388 | FLA274084 | | | A/G | A | 0.39 | 156186 | 156186 |
| 29088473 | 29088473 | SG13S10 | FLA274371 | | | A/T | T | 10.23 | 156473 | 156473 |
| 29089044 | 29089044 | SG13S3 | FLA274942 | | | C/T | T | 15.17 | 157044 | 157044 |
| 29089886 | 29089886 | SG13S368 | FLA275784 | DG00AAJEV | | C/T | T | 13.60 | 157886 | 157886 |
| 29090025 | 29090025 | SG13S369 | FLA275923 | DG00AAJEW | | G/T | G | 12.44 | 158025 | 158025 |
| 29090054 | 29090054 | SG13S370 | FLA275952 | DG00AAJEX | | A/G | A | 13.45 | 158054 | 158054 |
| 29090997 | 29090997 | SG13S4 | FLA276895 | | | G/C | G | 14.59 | 158997 | 158997 |
| 29091307 | 29091307 | SG13S5 | FLA277205 | | rs4238133 | G/T | T | 26.84 | 159307 | 159307 |
| 29091580 | 29091580 | SG13S389 | FLA277478 | | | A/G | A | 12.73 | 159580 | 159580 |
| 29091780 | 29091780 | SG13S90 | FLA277678 | | | A/C | C | 43.67 | 159780 | 159780 |
| 29092287 | 29092287 | SG13S390 | FLA278185 | | rs5004913 | A/G | A | 12.18 | 160287 | 160287 |
| 29092536 | 29092536 | SG13S6 | FLA278434 | | | A/G | A | 8.38 | 160536 | 160536 |
| 29092594 | 29092594 | SG13S391 | FLA278492 | | | A/G | G | 0.62 | 160594 | 160594 |
| 29092947 | 29092947 | SG13S392 | FLA278845 | | | G/T | T | 12.34 | 160947 | 160947 |
| 29093964 | 29093964 | SG13S371 | FLA279888 | DG00AAJEY | rs4409939 | A/G | G | 25.34 | 161964 | 161964 |
| 29094259 | 29094259 | SG13S372 | FLA280183 | DG00AAJEZ | | A/G | C | 0.24 | 162259 | 162259 |
| 29094999 | 29094999 | SG13S393 | FLA280923 | | | A/T | T | 25.66 | 162999 | 162999 |
| 29096688 | 29096688 | SG13S373 | FLA282612 | DG00AAJFA | | A/G | A | 14.84 | 164688 | 164688 |
| 29096813 | 29096813 | SG13S374 | FLA282737 | DG00AAJFB | | A/G | G | 12.37 | 164813 | 164813 |
| 29096874 | 29096874 | SG13S375 | FLA282798 | DG00AAJFC | | C/T | C | 14.55 | 164874 | 164874 |
| 29096962 | 29096962 | SG13S376 | FLA282886 | DG00AAJFD | | A/G | G | 11.99 | 164962 | 164962 |
| 29097476 | 29097476 | SG13S394 | FLA283400 | | | C/G | C | 14.66 | 165476 | 165476 |
| 29097553 | 29097553 | SG13S25 | FLA283477 | | | A/G | A | 12.21 | 165553 | 165553 |
| 29098486 | 29098486 | SG13S395 | FLA284410 | | | A/G | A | 0.79 | 166486 | 166486 |
| 29098891 | 29098891 | SG13S396 | FLA284815 | | | A/C | C | 10.15 | 166891 | 166891 |
| 29098979 | 29098979 | SG13S397 | FLA284903 | | | C/T | C | 3.53 | 166979 | 166979 |

-continued

| NCBI build34; start on chr. 13 (bp) | NCBI build34; stop on chr. 13 (bp) | SNP/ marker/ exon name | alias1 | alias2 | public SNP | Variation | minor allele | minor allele frequency (%) | start position in SEQ ID NO: 1 | end position in SEQ ID NO: 1 |
|---|---|---|---|---|---|---|---|---|---|---|
| 29101965 | 29101965 | SG13S377 | FLA287889 | DG00AAJFF |  | A/G | A | 12.45 | 169965 | 169965 |
| 29103909 | 29103909 | SG13S189 | FLA289833 |  |  | C/G | C | 0.62 | 171909 | 171909 |
| 29104271 | 29104271 | SG13S100 | FLA290195 | DG00AAHIK | rs4073259 | A/G | G | 31.55 | 172271 | 172271 |
| 29104629 | 29104629 | SG13S398 | FLA290553 |  |  | C/G | G | 4.94 | 172629 | 172629 |
| 29104646 | 29104646 | SG13S94 | FLA290570 |  | rs4073261 | C/T | C | 15.51 | 172646 | 172646 |
| 29105099 | 29105099 | SG13S101 | FLA291023 |  | rs4075474 | C/T | T | 27.91 | 173099 | 173099 |
| 29106329 | 29106329 | SG13S95 | FLA292253 |  |  | G/T | G | 14.74 | 174329 | 174329 |
| 29106652 | 29106652 | SG13S102 | FLA292576 |  |  | A/T | T | 1.17 | 174652 | 174652 |
| 29107138 | 29107138 | SG13S103 | FLA293062 |  |  | C/T | T | 1.28 | 175138 | 175138 |
| 29107404 | 29107404 | SG13S104 | FLA293328 |  |  | A/G | A | 2.17 | 175404 | 175404 |
| 29107668 | 29107812 | EXON1 |  |  |  |  |  |  | 175668 | 175812 |
| 29107830 | 29107830 | SG13S191 | FLA293754 | DG00AAFJT | rs4769055 | A/C | A | 30.11 | 175830 | 175830 |
| 29108398 | 29108398 | SG13S105 | FLA294322 |  |  | A/G | G | 0.66 | 176398 | 176398 |
| 29108579 | 29108579 | SG13S106 | FLA294503 | DG00AAHII |  | A/G | A | 28.31 | 176579 | 176579 |
| 29108919 | 29108919 | SG13S107 | FLA294843 |  | rs4075131 | A/G | G | 14.85 | 176919 | 176919 |
| 29108972 | 29108972 | SG13S108 | FLA294896 |  | rs4075132 | C/T | C | 1.21 | 176972 | 176972 |
| 29109112 | 29109112 | SG13S109 | FLA295036 |  |  | A/G | A | 1.04 | 177112 | 177112 |
| 29109182 | 29109182 | SG13S110 | FLA295106 |  |  | A/G | G | 0.88 | 177182 | 177182 |
| 29109344 | 29109344 | SG13S111 | FLA295268 |  | rs4597169 | C/T | C | 1.14 | 177344 | 177344 |
| 29109557 | 29109557 | SG13S112 | FLA295481 |  |  | C/T | T | 7.10 | 177557 | 177557 |
| 29109773 | 29109773 | SG13S113 | FLA295697 |  | rs4293222 | C/G | C | 22.52 | 177773 | 177773 |
| 29110096 | 29110096 | SG13S114 | FLA296020 | DG00AAHID |  | A/T | A | 20.86 | 178096 | 178096 |
| 29110178 | 29110178 | SG13S115 | FLA296102 |  |  | A/T | T | 13.83 | 178178 | 178178 |
| 29110508 | 29110508 | SG13S116 | FLA296432 |  | rs4769871 | C/T | T | 4.05 | 178508 | 178508 |
| 29110630 | 29110630 | SG13S117 | FLA296554 |  | rs4769872 | A/G | A | 4.07 | 178630 | 178630 |
| 29110689 | 29110689 | SG13S118 | FLA296613 |  | rs4769873 | C/T | T | 4.07 | 178689 | 178689 |
| 29110862 | 29110862 | SG13S119 | FLA296786 |  |  | A/G | A | 1.06 | 178862 | 178862 |
| 29111889 | 29111889 | SG13S120 | FLA297813 |  |  | C/T | C | 16.00 | 179889 | 179889 |
| 29112174 | 29112174 | SG13S121 | FLA298098 | DG00AAHIJ | rs4503649 | A/G | G | 49.36 | 180174 | 180174 |
| 29112264 | 29112264 | SG13S122 | FLA298188 | DG00AAHIH |  | A/G | A | 29.75 | 180264 | 180264 |
| 29112306 | 29112306 | SG13S123 | FLA298230 |  |  | C/T | T | 5.06 | 180306 | 180306 |
| 29112455 | 29112455 | SG13S43 | FLA298379 |  | rs3885907 | A/C | C | 46.23 | 180455 | 180455 |
| 29112583 | 29112583 | SG13S399 | FLA298507 |  |  | A/C | C | 1.59 | 180583 | 180583 |
| 29112680 | 29112680 | SG13S124 | FLA298604 |  | rs3922435 | C/T | T | 1.45 | 180680 | 180680 |
| 29113139 | 29113139 | SG13S125 | FLA299063 |  |  | A/G | G | 11.32 | 181139 | 181139 |
| 29114056 | 29114056 | SG13S400 | FLA299980 |  |  | A/G | A | 3.25 | 182056 | 182056 |
| 29114738 | 29114738 | SG13S126 | FLA300662 |  |  | A/G | A | 34.12 | 182738 | 182738 |
| 29114940 | 29114940 | SG13S127 | FLA300864 |  |  | A/G | G | 29.63 | 182940 | 182940 |
| 29115878 | 29115878 | SG13S128 | FLA302094 |  | rs4254165 | A/G | A | 45.68 | 183878 | 183878 |
| 29116020 | 29116020 | SG13S129 | FLA302236 |  | rs4360791 | A/G | G | 36.65 | 184020 | 184020 |
| 29116068 | 29116068 | SG13S130 | FLA302284 |  |  | G/T | G | 8.07 | 184068 | 184068 |
| 29116196 | 29116296 | EXON2 |  |  |  |  |  |  | 184196 | 184296 |
| 29116249 | 29116249 | SG13S190 | FLA302465 |  |  | C/T | T | 1.02 | 184249 | 184249 |
| 29116308 | 29116308 | SG13S192 | FLA302524 | B_SNP_302524 | rs3803277 | A/C | A | 49.57 | 184308 | 184308 |
| 29116344 | 29116344 | SG13S193 | FLA302560 |  |  | A/G | A | 0.58 | 184344 | 184344 |
| 29116401 | 29116401 | SG13S88 | FLA302617 | B_SNP_302617 | rs3803278 | C/T | C | 24.71 | 184401 | 184401 |
| 29116688 | 29116688 | SG13S131 | FLA302904 |  |  | C/T | T | 7.19 | 184688 | 184688 |
| 29117133 | 29117133 | SG13S132 | FLA303349 |  |  | A/C | A | 1.10 | 185133 | 185133 |
| 29117546 | 29117546 | SG13S133 | FLA303762 |  | rs4356336 | C/T | T | 37.65 | 185546 | 185546 |
| 29117553 | 29117553 | SG13S38 | FLA303769 |  | rs4584668 | A/T | A | 45.50 | 185553 | 185553 |
| 29117580 | 29117580 | SG13S134 | FLA303796 |  |  | C/T | T | 1.22 | 185580 | 185580 |
| 29117741 | 29117741 | SG13S135 | FLA303957 |  | rs4238137 | C/T | T | 0.89 | 185741 | 185741 |
| 29117954 | 29117954 | SG13S136 | FLA304170 |  | rs4147063 | C/T | T | 36.69 | 185954 | 185954 |
| 29118118 | 29118118 | SG13S137 | FLA304334 | DG00AAHIG | rs4147064 | C/T | T | 29.11 | 186118 | 186118 |
| 29118815 | 29118815 | SG13S86 | FLA305031 |  |  | A/G | A | 30.19 | 186815 | 186815 |
| 29118873 | 29118873 | SG13S87 | FLA305089 | DG00AAHOJ |  | A/G | G | 3.29 | 186873 | 186873 |
| 29119069 | 29119069 | SG13S138 | FLA305285 |  |  | C/T | G | 36.96 | 187069 | 187069 |
| 29119138 | 29119138 | SG13S139 | FLA305354 |  |  | C/G | G | 36.63 | 187138 | 187138 |
| 29119289 | 29119289 | SG13S140 | FLA305505 |  |  | A/G/T | T | 37.34 | 187289 | 187289 |
| 29119462 | 29119462 | SG13S141 | FLA305678 |  |  | C/T | C | 1.15 | 187462 | 187462 |
| 29119740 | 29119740 | SG13S39 | FLA305956 |  |  | G/T | T | 9.91 | 187740 | 187740 |
| 29120939 | 29120939 | SG13S142 | FLA307155 |  | rs4387455 | C/T | C | 3.36 | 188939 | 188939 |
| 29120949 | 29120949 | SG13S143 | FLA307165 |  | rs4254166 | C/T | T | 36.24 | 188949 | 188949 |
| 29121342 | 29121342 | SG13S144 | FLA307558 |  | rs4075692 | A/G | A | 31.58 | 189342 | 189342 |
| 29121572 | 29121572 | SG13S145 | FLA307788 |  |  | C/G | G | 0.45 | 189572 | 189572 |
| 29121988 | 29121988 | SG13S146 | FLA308204 |  |  | C/T | T | 1.14 | 189988 | 189988 |
| 29122253 | 29122253 | SG13S26 | FLA308469 |  |  | C/T | T | 46.57 | 190253 | 190253 |
| 29122283 | 29122283 | SG13S27 | FLA308499 |  |  | A/G | A | 10.34 | 190283 | 190283 |
| 29122294 | 29122294 | SG13S147 | FLA308510 |  |  | C/T | T | 8.00 | 190294 | 190294 |
| 29122298 | 29122298 | SG13S28 | FLA308514 |  |  | G/T | T | 33.71 | 190298 | 190298 |
| 29122311 | 29122311 | SG13S148 | FLA308527 |  |  | G/T | T | 2.29 | 190311 | 190311 |
| 29123370 | 29123370 | SG13S98 | FLA309586 |  |  | G/T | G | 1.19 | 191370 | 191370 |
| 29123635 | 29123635 | SG13S149 | FLA309851 |  |  | A/G | A | 1.01 | 191635 | 191635 |
| 29123643 | 29123643 | SG13S29 | FLA309859 |  |  | A/C | A | 47.88 | 191643 | 191643 |

-continued

| NCBI build34; start on chr. 13 (bp) | NCBI build34; stop on chr. 13 (bp) | SNP/ marker/ exon name | alias1 | alias2 | public SNP | Variation | minor allele | minor allele frequency (%) | start position in SEQ ID NO: 1 | end position in SEQ ID NO: 1 |
|---|---|---|---|---|---|---|---|---|---|---|
| 29124188 | 29124259 | EXON3 | | | | | | | 192188 | 192259 |
| 29124441 | 29124441 | SG13S89 | FLA310657 | B_SNP_310657 | rs4769874 | A/G | A | 4.68 | 192441 | 192441 |
| 29124906 | 29124906 | SG13S96 | FLA311122 | | rs4072653 | A/G | G | 29.72 | 192906 | 192906 |
| 29125032 | 29125032 | SG13S150 | FLA311248 | | | C/G | C | 8.22 | 193032 | 193032 |
| 29125521 | 29125521 | SG13S401 | FLA311737 | | | C/T | C | 21.10 | 193521 | 193521 |
| 29125822 | 29125822 | SG13S151 | FLA312038 | | | C/T | T | 8.57 | 193822 | 193822 |
| 29125840 | 29125840 | SG13S30 | FLA312056 | | | G/T | G | 23.23 | 193840 | 193840 |
| 29127301 | 29127301 | SG13S31 | FLA313550 | | | C/T | T | 24.20 | 195301 | 195301 |
| 29128080 | 29128162 | EXON4 | | | | | | | 196080 | 196162 |
| 29128284 | 29128284 | SG13S152 | FLA314500 | | | C/G | C | 23.89 | 196284 | 196284 |
| 29128316 | 29128316 | SG13S402 | FLA314532 | | rs4468448 | C/T | T | 19.33 | 196316 | 196316 |
| 29128798 | 29128798 | SG13S403 | FLA315014 | | rs4399410 | A/G | G | 11.50 | 196798 | 196798 |
| 29129016 | 29129016 | SG13S153 | FLA315232 | | | A/T | T | 3.08 | 197016 | 197016 |
| 29129139 | 29129139 | SG13S97 | FLA315355 | | | A/G | A | 9.72 | 197139 | 197139 |
| 29129154 | 29129154 | SG13S154 | FLA315370 | | | C/T | T | 0.98 | 197154 | 197154 |
| 29129395 | 29129395 | SG13S40 | FLA315611 | | | G/T | T | 2.24 | 197395 | 197395 |
| 29129915 | 29129915 | SG13S155 | FLA316131 | | rs4769875 | A/G | A | 1.43 | 197915 | 197915 |
| 29130192 | 29130192 | SG13S156 | FLA316408 | | | A/C | A | 1.80 | 198192 | 198192 |
| 29130256 | 29130256 | SG13S157 | FLA316472 | | | A/G | G | 2.38 | 198256 | 198256 |
| 29130299 | 29130299 | SG13S158 | FLA316515 | | | A/C | A | 0.61 | 198299 | 198299 |
| 29130353 | 29130353 | SG13S159 | FLA316569 | | | G/T | G | 2.55 | 198353 | 198353 |
| 29130391 | 29130391 | SG13S160 | FLA316607 | | | C/T | T | 0.83 | 198391 | 198391 |
| 29130547 | 29130547 | SG13S32 | FLA316763 | | | A/C | C | 48.50 | 198547 | 198547 |
| 29131280 | 29131280 | SG13S161 | FLA317496 | | | A/G | G | 2.44 | 199280 | 199280 |
| 29131403 | 29131403 | SG13S162 | FLA317619 | | | A/G | G | 2.45 | 199403 | 199403 |
| 29131404 | 29131404 | SG13S163 | FLA317620 | | | C/T | C | 2.45 | 199404 | 199404 |
| 29131431 | 29131431 | SG13S164 | FLA317647 | | rs4769058 | C/T | T | 2.55 | 199431 | 199431 |
| 29131517 | 29131517 | SG13S165 | FLA317733 | | | A/T | T | 20.00 | 199517 | 199517 |
| 29131528 | 29131528 | SG13S166 | FLA317744 | | rs4769059 | C/T | T | 2.46 | 199528 | 199528 |
| 29131599 | 29131599 | SG13S167 | FLA317815 | | rs4769876 | A/G | A | 3.50 | 199599 | 199599 |
| 29132003 | 29132003 | SG13S168 | FLA318219 | | | A/C | C | 8.39 | 200003 | 200003 |
| 29133753 | 29133753 | SG13S33 | FLA319969 | | | G/T | T | 8.99 | 201753 | 201753 |
| 29134045 | 29134045 | SG13S41 | FLA320261 | | | A/G | G | 5.41 | 202045 | 202045 |
| 29134177 | 29134177 | SG13S169 | FLA320393 | | | A/G | G | 4.12 | 202177 | 202177 |
| 29134379 | 29134379 | SG13S404 | FLA320595 | | rs4427651 | G/T | G | 38.33 | 202379 | 202379 |
| 29135558 | 29135558 | SG13S170 | FLA321774 | | rs3935645 | C/T | C | 32.77 | 203558 | 203558 |
| 29135640 | 29135640 | SG13S171 | FLA321856 | | rs3935644 | A/G | A | 48.03 | 203640 | 203640 |
| 29135750 | 29135750 | SG13S172 | FLA321966 | | | A/G | G | 1.67 | 203750 | 203750 |
| 29135809 | 29135809 | SG13S173 | FLA322025 | | | A/T | A | 0.68 | 203809 | 203809 |
| 29135877 | 29135877 | SG13S42 | FLA322093 | | rs4769060 | A/G | G | 42.44 | 203877 | 203877 |
| 29136080 | 29136556 | EXON5 | | | | | | | 204080 | 204556 |
| 29136290 | 29136290 | SG13S194 | FLA322506 | | | C/T | T | 0.30 | 204290 | 204290 |
| 29136462 | 29136462 | SG13S195 | FLA322678 | | rs1132340 | A/G | G | 2.46 | 204462 | 204462 |
| 29136797 | 29136797 | SG13S174 | FLA323013 | | | A/G | G | 0.56 | 204797 | 204797 |
| 29137100 | 29137100 | SG13S34 | FLA323316 | | | G/T | G | 30.23 | 205100 | 205100 |
| 29137150 | 29137150 | SG13S175 | FLA323366 | | | A/G | A | 2.40 | 205150 | 205150 |
| 29137607 | 29137607 | SG13S176 | FLA323823 | | | A/G | A | 2.24 | 205607 | 205607 |
| 29137651 | 29137651 | SG13S177 | FLA323867 | | | C/T | T | 1.64 | 205651 | 205651 |
| 29137905 | 29137905 | SG13S178 | FLA324121 | | | C/G | C | 1.40 | 205905 | 205905 |
| 29138117 | 29138117 | SG13S35 | FLA324333 | | | A/G | A | 9.52 | 206117 | 206117 |
| 29138375 | 29138375 | SG13S179 | FLA324591 | | | A/G | A | 48.14 | 206375 | 206375 |
| 29138385 | 29138385 | SG13S180 | FLA324601 | | | C/T | T | 2.50 | 206385 | 206385 |
| 29138633 | 29138633 | SG13S181 | FLA324849 | DG00AAHIF | rs4420371 | C/G | C | 49.41 | 206633 | 206633 |
| 29139153 | 29139153 | SG13S182 | FLA325369 | | | C/T | T | 2.36 | 207153 | 207153 |
| 29139277 | 29139277 | SG13S183 | FLA325493 | | rs4466940 | C/T | T | 12.07 | 207277 | 207277 |
| 29139435 | 29139435 | SG13S184 | FLA325651 | DG00AAHOI | rs4445746 | A/G | A | 16.67 | 207435 | 207435 |
| 29139971 | 29139971 | SG13S185 | FLA326187 | | | A/G | G | 7.66 | 207971 | 207971 |
| 29140441 | 29140441 | SG13S405 | FLA326657 | | | A/G | A | 9.66 | 208441 | 208441 |
| 29140649 | 29140649 | SG13S91 | FLA326865 | | | A/G | A | 7.78 | 208649 | 208649 |
| 29140695 | 29140695 | SG13S186 | FLA326911 | | rs4769877 | A/T | A | 25.71 | 208695 | 208695 |
| 29140703 | 29140703 | SG13S187 | FLA326919 | | | A/G | A | 1.43 | 208703 | 208703 |
| 29140805 | 29140805 | SG13S188 | FLA327021 | DG00AAJFE | | A/G | G | 4.71 | 208805 | 208805 |
| 29141049 | 29141049 | SG13S406 | FLA327265 | | | C/T | T | 0.56 | 209049 | 209049 |
| 29142392 | 29142392 | SG13S92 | FLA328644 | | rs4429158 | C/T | T | 8.33 | 210392 | 210392 |
| 29142397 | 29142397 | SG13S93 | FLA328649 | | | A/G | A | 7.23 | 210397 | 210397 |
| 29142712 | 29142712 | SG13S36 | FLA328964 | | | C/T | C | 15.88 | 210712 | 210712 |
| 29144013 | 29144013 | SG13S407 | FLA330265 | | | C/T | T | 3.29 | 212013 | 212013 |
| 29144203 | 29144203 | SG13S408 | FLA330455 | | | C/T | T | 0.30 | 212203 | 212203 |
| 29144234 | 29144589 | D13S1238 | | | | | | | 212234 | 212589 |
| 29144255 | 29144255 | SG13S7 | FLA330507 | | | C/T | T | 16.28 | 212255 | 212255 |
| 29144877 | 29144877 | SG13S37 | FLA331129 | | | A/G | G | 16.70 | 212877 | 212877 |
| 29144982 | 29144982 | SG13S409 | FLA331234 | | | A/G | A | 1.93 | 212982 | 212982 |
| 29144983 | 29144983 | SG13S8 | FLA331235 | | rs4491352 | A/C | C | 30.64 | 212983 | 212983 |
| 29145122 | 29145122 | SG13S410 | FLA331374 | | rs4319601 | C/T | T | 20.57 | 213122 | 213122 |

-continued

| NCBI build34; start on chr. 13 (bp) | NCBI build34; stop on chr. 13 (bp) | SNP/ marker/ exon name | alias1 | alias2 | public SNP | Variation | minor allele | minor allele frequency (%) | start position in SEQ ID NO: 1 | end position in SEQ ID NO: 1 |
|---|---|---|---|---|---|---|---|---|---|---|
| 29145143 | 29145143 | SG13S411 | FLA331395 | | | A/G | A | 1.54 | 213143 | 213143 |
| 29145171 | 29145171 | SG13S9 | FLA331423 | | | C/T | C | 16.37 | 213171 | 213171 |
| 29145221 | 29145221 | SG13S412 | FLA331473 | | rs4769062 | A/G | A | 7.42 | 213221 | 213221 |
| 29145265 | 29145265 | SG13S413 | FLA331517 | | rs4238138 | C/T | T | 1.91 | 213265 | 213265 |

TABLE 14

Extended 4 microsatellite marker haplotypes
4 markers: pos. rr-frqgt1perc

| Length | p-val | RR | N_af | P_al | P_ca | N_ct | P_al | P_ca | Alleles | | | | Markers |
|---|---|---|---|---|---|---|---|---|---|---|---|---|---|
| 0.88 | 4.71E−06 | 6.23 | 428 | 0.065 | 0.125 | 721 | 0.011 | 0.022 | 0 | −12 | −6 | 0 | DG13S80<br>DG13S83<br>DG13S1110<br>DG13S163 |
| 0.82 | 8.60E−06 | INF | 438 | 0.032 | 0.062 | 720 | 0 | 0 | 0 | 4 | 2 | 14 | DG13S111<br>1 DG13S1103<br>D13S1287<br>DG13S1061 |
| 0.67 | 6.98E−06 | 19.91 | 435 | 0.03 | 0.059 | 721 | 0.002 | 0.003 | 8 | 6 | 0 | 8 | DG13S1103<br>DG13S163<br>D13S290<br>DG13S1061 |
| 0.767 | 4.85E−06 | 26.72 | 436 | 0.048 | 0.094 | 721 | 0.002 | 0.004 | 0 | 0 | 2 | 12 | DG13S1101<br>DG13S166<br>D13S1287<br>DG13S1061 |
| 0.515 | 1.93E−06 | INF | 422 | 0.048 | 0.094 | 721 | 0 | 0 | 2 | 0 | 0 | 6 | DG13S166<br>DG13S163<br>D13S290<br>DG13S1061 |
| 0.864 | 1.68E−06 | INF | 424 | 0.024 | 0.048 | 717 | 0 | 0 | 0 | 2 | 0 | −16 | DG13S166<br>DG13S163<br>DG13S1061<br>DG13S293 |
| 0.927 | 5.38E−06 | INF | 435 | 0.034 | 0.067 | 720 | 0 | 0 | 4 | 2 | 14 | 3 | DG13S1103<br>D13S1287<br>DG13S1061<br>DG13S301 |

Alleles #'s: For SNP alleles A = 0, C = 1, G = 2, T = 3; for microsatellite alleles: the CEPH sample (Centre d'Etudes du Polymorphisme Humain, genomics repository) is used as a reference, as described above.
Length = length of haplotype in Mb.
P-val = p-value. RR = Relative risk.
N af = Number of patients.
P al = allelic frequency of haplotype.
P ca = carrier frequency of haplotype.
N ct = number of controls.
Alleles = alleles in the haplotype.
Markers = markers in the haplotype.

TABLE 15

Extended 5 microsatellite marker haplotypes
5 markers: pos. rr-frqgt1perc

| Length | p-val | RR | N_af | P_al | P_ca | N_ct | P_al | P_ca | Alleles | | | | Markers |
|---|---|---|---|---|---|---|---|---|---|---|---|---|---|
| 0.851 | 7.45E−06 | 15.43 | 413 | 0.034 | 0.067 | 715 | 0.002 | 0.005 | 0 | 18 | 0 | 0 | 0 | DG13S79<br>D13S1299<br>DG13S87<br>D13S1246<br>DG13S166 |
| 0.964 | 8.07E−06 | INF | 437 | 0.023 | 0.045 | 721 | 0 | 0 | 0 | −12 | 6 | 8 | 6 | DG13S79<br>DG13S83<br>DG13S1104<br>DG13S1103<br>DG13S163 |
| 0.964 | 2.38E−06 | INF | 437 | 0.026 | 0.052 | 720 | 0 | 0 | 0 | 6 | 0 | 8 | 6 | DG13S79<br>DG13S1104 |

TABLE 15-continued

Extended 5 microsatellite marker haplotypes
5 markers: pos. rr-frqgt1perc

| Length | p-val | RR | N_af | P_al | P_ca | N_ct | P_al | P_ca | Alleles | | | | | Markers |
|---|---|---|---|---|---|---|---|---|---|---|---|---|---|---|
| 0.931 | 7.05E−06 | 5.8 | 429 | 0.068 | 0.131 | 721 | 0.012 | 0.025 | 0 | −6 | 0 | 0 | −2 | DG13S172<br>DG13S1103<br>DG13S163<br>DG13S79<br>DG13S1110 |
| 0.964 | 8.13E−06 | INF | 434 | 0.021 | 0.041 | 721 | 0 | 0 | 0 | 3 | 8 | 2 | 6 | DG13S175<br>DG13S166<br>D13S1238<br>DG13S79<br>DG13S1098 |
| 0.597 | 9.78E−06 | 4.58 | 428 | 0.074 | 0.143 | 717 | 0.017 | 0.034 | −6 | 0 | 0 | 0 | −2 | DG13S1103<br>DG13S163<br>DG13S1110<br>DG13S89<br>DG13S175 |
| 0.896 | 6.92E−06 | INF | 428 | 0.026 | 0.051 | 721 | 0 | 0 | −12 | −6 | 0 | −2 | 2 | DG13S166<br>D13S1238<br>DG13S83<br>DG13S1110<br>DG13S166 |
| 0.722 | 2.18E−06 | INF | 453 | 0.026 | 0.051 | 738 | 0 | 0 | −6 | 0 | 0 | −2 | 2 | D13S1238<br>D13S290<br>DG13S1110<br>D13S289<br>DG13S166 |
| 0.982 | 7.88E−06 | INF | 437 | 0.028 | 0.055 | 721 | 0 | 0 | 0 | 0 | 4 | 2 | 14 | D13S1238<br>D13S290<br>DG13S87<br>DG13S175<br>DG13S1103 |
| 0.841 | 8.88E−06 | INF | 438 | 0.032 | 0.062 | 720 | 0 | 0 | 0 | 0 | 4 | 2 | 14 | D13S1287<br>DG13S1061<br>DG13S89<br>DG13S1111<br>DG13S1103 |
| 0.841 | 9.67E−07 | INF | 435 | 0.029 | 0.057 | 721 | 0 | 0 | 0 | 8 | 6 | 0 | 8 | D13S1287<br>DG13S1061<br>DG13S89<br>DG13S1103<br>DG13S163 |
| 0.982 | 7.90E−06 | 18.63 | 437 | 0.026 | 0.052 | 721 | 0.001 | 0.003 | 0 | 4 | 0 | 2 | 14 | D13S290<br>DG13S1061<br>DG13S87<br>DG13S1103<br>DG13S166 |
| 0.841 | 3.52E−06 | 28.52 | 436 | 0.048 | 0.094 | 721 | 0.002 | 0.004 | 0 | 0 | 0 | 2 | 12 | D13S1287<br>DG13S1061<br>DG13S89<br>DG13S1101<br>DG13S166 |
| 0.705 | 5.28E−06 | INF | 435 | 0.027 | 0.053 | 721 | 0 | 0 | 0 | 8 | 6 | 0 | 8 | D13S1287<br>DG13S1061<br>DG13S175<br>DG13S1103<br>DG13S163 |
| 0.841 | 4.21E−06 | INF | 422 | 0.048 | 0.093 | 721 | 0 | 0 | 0 | 2 | 0 | 0 | 6 | D13S290<br>DG13S1061<br>DG13S89<br>DG13S166<br>DG13S163 |
| 0.767 | 4.02E−06 | 28.11 | 436 | 0.049 | 0.095 | 721 | 0.002 | 0.004 | 0 | 0 | 0 | 2 | 12 | D13S290<br>DG13S1061<br>DG13S1101<br>DG13S175<br>DG13S166 |
| 0.767 | 1.29E−06 | 31.07 | 436 | 0.047 | 0.092 | 721 | 0.002 | 0.003 | 0 | 0 | 0 | 2 | 12 | D13S1287<br>DG13S1061<br>DG13S1101<br>DG13S172<br>D13S1287 |
| 0.705 | 4.25E−07 | INF | 422 | 0.048 | 0.093 | 721 | 0 | 0 | 0 | 2 | 0 | 0 | 6 | DG13S1061<br>DG13S175<br>DG13S166 |

TABLE 15-continued

Extended 5 microsatellite marker haplotypes
5 markers: pos. rr-frqgt1perc

| Length | p-val | RR | N_af | P_al | P_ca | N_ct | P_al | P_ca | Alleles | | | | | Markers |
|---|---|---|---|---|---|---|---|---|---|---|---|---|---|---|
| 0.683 | 6.58E−06 | INF | 437 | 0.029 | 0.056 | 721 | 0 | 0 | 0 | 4 | 0 | 2 | 14 | DG13S163<br>D13S290<br>DG13S1061<br>DG13S172<br>DG13S1103<br>DG13S166<br>D13S1287 |
| 0.767 | 2.85E−06 | 32.43 | 436 | 0.044 | 0.087 | 721 | 0.001 | 0.003 | 0 | 0 | 0 | 2 | 12 | DG13S1061<br>DG13S1101<br>DG13S166<br>D13S290<br>D13S1287 |
| 0.865 | 9.58E−06 | 18.39 | 451 | 0.023 | 0.045 | 739 | 0.001 | 0.003 | 0 | 0 | 2 | 2 | −16 | DG13S1061<br>D13S289<br>DG13S166<br>DG13S163<br>D13S1287 |
| 0.865 | 5.08E−06 | INF | 453 | 0.019 | 0.038 | 739 | 0 | 0 | 0 | 0 | 2 | 0 | −16 | DG13S293<br>D13S289<br>DG13S166<br>DG13S163<br>DG13S1061 |
| 0.927 | 1.02E−07 | 27.65 | 437 | 0.037 | 0.073 | 721 | 0.001 | 0.003 | 4 | 0 | 2 | 14 | 3 | DG13S293<br>DG13S1103<br>DG13S166<br>D13S1287<br>DG13S1061<br>DG13S301 |

Length = length of haplotype in Mb.
P-val = p-value.
RR = Relative risk.
N af = Number of patients.
P al = allelic frequency of haplotype.
P ca = carrier frequency of haplotype.
N ct = number of controls.
Alleles = alleles in the haplotype.
Markers = markers in the haplotype

EXAMPLE 2

Relationship Between Polymorphism in the 5-Lipoxygenase Promoter and MI

A family of mutations in the G-C rich transcription factor binding region of the 5-LO gene has previously been identified. These mutations consist of deletion of one, deletion of two, or addition of one zinc finger (Sp1/Egr-1) binding sites in the region 176 to 147 bp upstream from the ATG translation start site where there are normally 5 Sp1 binding motifs in tandem. These naturally occurring mutations in the human 5-LO gene promoter have been shown to modify transcription factor binding and reporter gene transcription. The capacity of the mutant forms of DNA to promote transcription of CAT reporter constructs have been shown to be significantly less than that of the wild type DNA (*J. Clin. Invest*. Volume 99, Number 5, March 1997, 1130-1137).

To test whether 5-LO is associated with the atherosclerotic diseases, particularly myocardial infarction (MI) in the human population, this promoter polymorphism, consisting of variable number of tandem Sp1/Egr-1 binding sites, was genotyped in 1112 MI patients, 748 patients with PAOD, and 541 stroke patients.

The results, shown in Table 16, demonstrate that the wild type allele (which represents the allele with the most active promoter and thus with the highest expression of the 5-LO mRNA; *J. Clin. Invest*. Volume 99, Number 5, March 1997, 1130-1137) is significantly associated with MI (RR=1.2, $p<0.05$). The results are consistent with a disease hypothesis that increased expression of the 5-LO plays a role in the pathogenesis of MI.

TABLE 16

| | N_aff | Frq_aff | N_ctrl | Frq_ctrl | Risk Ratio | P-value |
|---|---|---|---|---|---|---|
| MI patients | 1112 | 0.8701 | 734 | 0.8501 | 1.1803 | 0.048 |
| Independent | 969 | 0.8720 | 734 | 0.8501 | 1.2013 | 0.037 |
| Males | 646 | 0.8740 | 734 | 0.8501 | 1.2232 | 0.039 |
| Females | 465 | 0.8645 | 734 | 0.8501 | 1.1249 | 0.180 |
| Age of onset < 60 | 522 | 0.8745 | 734 | 0.8501 | 1.2286 | 0.046 |
| Males | 353 | 0.8768 | 734 | 0.8501 | 1.2542 | 0.053 |
| Females | 169 | 0.8698 | 734 | 0.8501 | 1.1779 | 0.202 |
| PAOD patients | 748 | 0.8763 | 734 | 0.8501 | 1.2492 | 0.022 |
| Independent | 703 | 0.8755 | 734 | 0.8501 | 1.2400 | 0.027 |
| Males | 473 | 0.8774 | 734 | 0.8501 | 1.2613 | 0.033 |
| Females | 275 | 0.8745 | 734 | 0.8501 | 1.2289 | 0.092 |
| Stroke patients | 541 | 0.8743 | 734 | 0.8501 | 1.2262 | 0.046 |
| Males | 326 | 0.8758 | 734 | 0.8501 | 1.2427 | 0.067 |
| Females | 215 | 0.8721 | 734 | 0.8501 | 1.2019 | 0.144 |
| Cardio/Large V | 202 | 0.8861 | 734 | 0.8501 | 1.3719 | 0.038 |
| Cardioembolic | 114 | 0.8772 | 734 | 0.8501 | 1.2592 | 0.165 |
| Large Vessel | 88 | 0.8977 | 734 | 0.8501 | 1.5474 | 0.053 |

TABLE 16-continued

|  | N_aff | Frq_aff | N_ctrl | Frq_ctrl | Risk Ratio | P-value |
|---|---|---|---|---|---|---|
| Small Vessel | 77 | 0.8831 | 734 | 0.8501 | 1.2791 | 0.163 |
| Hemorrhagic | 27 | 0.9259 | 734 | 0.8501 | 2.2035 | 0.081 |

Single sided p-values: Fisher exact test.
N_aff = number of affected individuals;
Frq_aff = frequency of the wild type allele of the promoter polymorphism in the affected group;
N_ctrl = number of controls;
Frq_ctrl = frequency of the wild type allele of the promoter polymorphism in the control group;

EXAMPLE 3

Elevated Lte4 Biosynthesis in Individuals with the Flap Mi-Risk Haplotype

Based on the known function of the end products of the leukotriene pathway and based on our 5-LO association data, the association of the FLAP haplotype with MI is best explained by increased expression and/or increased function of the FLAP gene. In other words, those individuals that have a "at risk" FLAP haplotype have either, or both, increased amount of FLAP, or more active FLAP. This would lead to increased production of leukotrienes in these individuals.

To demonstrate this theory, LTE4, a downstream leukotriene metabolite, was measured in patient serum samples as described in detail in International Application No. PCT/US2005/03312 (Publication No. WO2005/075022) incorporated herein by reference in its entirety.

Table 17 (below) shows that the female MI "at risk" haplotype was more associated with female MI patients who have high LTE4 levels (top 50th percentile), than with female MI patients who have low levels of LTE4 (bottom 50th percentile).

In addition, haplotype analysis, comparing female MI patients with high levels of LTE4 with female patients with low levels, showed that those with high levels had increased prevalence of the "at risk" haplotype by 1.6 fold (see Table 18). Although the association did not rise to the level of statistical significance, the results show clearly that the "at risk" haplotypes are enriched in the MI patient group that has high levels of LTE4. The carrier frequency of the "at risk" haplotypes are 12% and 20%, respectively, in the whole female MI group, but go up to 15% and 24%, respectively, in the female MI group that has high levels of LTE4. Correspondingly, the carrier frequency of the "at risk" haplotypes decrease to 8% and 18%, respectively, in the group of female MI that has low levels of LTE4 (Note carrier frequencies are twice the disease allele frequency times 1 minus the disease allele frequency plus the square of the disease allele frequency).

Note that LTE4 may simply reflect the leukotriene synthesis rate of the leukotriene synthetic pathway upstream of the key leukotriene metabolite involved in MI risk. For example, leukotriene B4 is probably more likely than leukotriene E4 to be involved in the inflammatory aspects of MI plaques but since B4 has a short half life, it is difficult to measure reliably in serum samples, while E4 has long term stability.

TABLE 17

Association of the at risk haplotypes for female MI, with female MI who also have high levels of LTE4 (>50 pg/ml (roughly the upper 50th percentile).

| | SG13S418 | SG13S420 | DG13S166 | SG13S114 | SG13S88 | SG13S184 | D13S1238 |
|---|---|---|---|---|---|---|---|
| High LTE4 | | | | | | | |
| | C | T | 0 | T | T | G | -2 |
| | C | T | 0 | | | G | -2 |
| Low LTE4 | | | | | | | |
| | C | T | 0 | T | T | G | -2 |
| | C | T | 0 | | | G | -2 |

| | p-val | N_aff | aff. frq | N_ctrl | ctrl. frq | rel_risk | PAR | info |
|---|---|---|---|---|---|---|---|---|
| High LTE4 | | | | | | | | |
| | 3.72E−06 | 221 | 0.075 | 809 | 0.014 | 5.51 | 0.115 | 0.565 |
| | 2.30E−05 | 220 | 0.122 | 809 | 0.046 | 2.89 | 0.154 | 0.608 |
| Low LTE4 | | | | | | | | |
| | 4.65E−02 | 185 | 0.040 | 809 | 0.015 | 2.67 | 0.048 | 0.511 |
| | 2.88E−02 | 182 | 0.087 | 809 | 0.048 | 1.89 | 0.08 | 0.622 |

P-val: p-value for the association.
N_aff: Number of patients used in the analysis.
Aff. frq: haplotype frequency in patients.
N_ctrl: number of controls used in the analysis.
Ctrl. frq: Haplotype frequency in controls.
Rel_risk: Relative risk of the haplotype.
PAR: population attributable risk.
Info: information content. Less association was found between the at risk haplotype for female MI, with female MI who also have low levels of LTE4 (<50 pg/ml).

TABLE 18

Association between haplotypes that were most significantly associated with female MI, and serum LTE4 levels.

| | SG13S418 | SG13S420 | DG13S166 | SG13S114 | SG13S88 | SG13S184 | D13S1238 |
|---|---|---|---|---|---|---|---|
| High vs low LTE4 | C | T | 0 | T | T | G | −2 |
| | C | T | 0 | | | G | −2 |

| | p-val | N_aff | aff. frq | N_ctrl | ctrl. frq | rel_risk | PAR | info |
|---|---|---|---|---|---|---|---|---|
| High vs low LTE4 | 1.61E−01 | 221 | 0.084 | 185 | 0.054 | 1.61 | 0.063 | 0.689 |
| | 1.20E−01 | 220 | 0.13 | 182 | 0.088 | 1.54 | 0.089 | 0.686 |

P-val: p-value for the association.
N_aff: Number of patients used in the analysis.
Aff. frq: haplotype frequency in patients.
N_ctrl: number of controls used in the analysis.
Ctrl. frq: Haplotype frequency in controls.
Rel_risk: Relative risk of the haplotype.
PAR: population attributable risk.
Info: information content. Here, the group of affected individuals were defined as female MI patients with high serum LTE4 (higher than 50 pg/ml) and the control group is defined as female MI patients with low serum LTE4 (below 50 pg/ml).

EXAMPLE 4

Elevated LTE4 Correlated with Elevated C-Reactive Protein (CRP)

Figure 4:
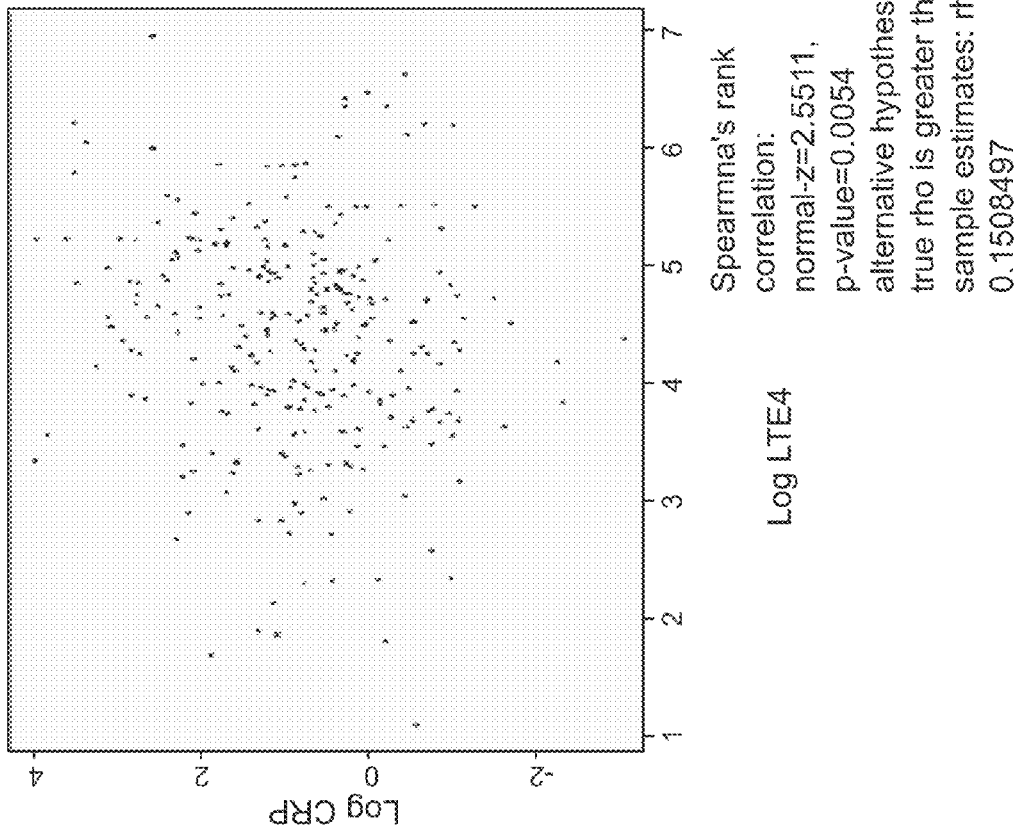
FIG. 4 shows a significant positive correlation between serum LTE4 levels and serum CRP levels.

The relationship between the increased production of leukotrienes and the inflammatory marker CRP, a well established risk factor for MI, was then explored. As shown in FIG. 4, a significant positive correlation was found between serum LTE4 levels and serum CRP levels.

EXAMPLE 5

Assessment of Level of CRP in Patients with At-Risk Haplotype

The level of CRP in female patients with female MI at-risk haplotypes was assessed, in order to assess whether there was a presence of a raised level of inflammatory marker in the presence of the female MI at-risk haplotype. Results are shown in Table 19. Although the association did not rise to the level of statistical significance, it was demonstrated that the average CRP was elevated in those patients with the at-risk haplotype versus those without it.

TABLE 19

| | All female patients | | | |
|---|---|---|---|---|
| | | no | Mean CRP | SE CRP |
| affecteds: | With haplotype. | 155 | 4.91 | 8.7 |
| | Not with haplotype. | 218 | 4.35 | 6.13 |

EXAMPLE 6

Elevated Serum LTE-4 Levels in MI Patients Versus Controls

The end products of the leukotriene pathway are potent inflammatory lipid mediators that can potentially contribute to development of atherosclerosis and destabilization of atherosclerotic plaques through lipid oxidation and/or proinflammatory effects. Examples one through five show that: 1) MI correlates with genetic variation at FLAP; 2) MI correlates with high expression promoter polymorphism at 5-LO; 3) C-reactive protein levels correlate with serum leukotriene E4; and 4) Patients with MI-risk FLAP haplotypes have higher levels of serum leukotriene E4 and CRP. Based on these data, it was hypothesized that serum leukotriene E4 levels correlate with MI risk.

To test this hypothesis, LTE4, a downstream leukotriene metabolite, was measured in 488 female MI patient and 164 control serum samples. The LTE4 levels for the patients were higher than that for the controls using a one-sided Wilcoxon rank-sum test. The p-value of the difference was 0.0092, thus confirming our hypothesis. Therefore, elevated leukotriene E4 represents a risk factor for MI. Serum or plasma LTE4 levels may be used to profile the MI risk for individuals to aid in deciding which treatment and lifestyle management plan is best for primary or secondary MI prevention. In the same way other leukotriene metabolites may be used to risk profile for MI.

EXAMPLE 7

Increased LTB4 Production in Activated Neutrophils From MI Patients

A principal bioactive product of one of the two branches of the 5-LO pathway is LTB4. To determine whether the patients with past history of MI have increased activity of the 5-LO pathway compared to controls, the LTB4 production in isolated blood neutrophils was measured before and after stimulation in vitro with the calcium ionophore, ionomycin as described in detail in International Application No. PCT/US2005/03312 (Publication No. WO2005/075022) incorporated herein by reference in its entirety. No difference was detected between the LTB4 production in resting neutrophils from MI patients or controls (results not shown). In contrast, the LTB4 generation by neutrophils from MI patients stimulated with the ionophore was significantly greater than by neutrophils from controls at 15 and 30 minutes, respectively. Moreover, the observed increase in the LTB4 release was largely accounted for by male carriers of haplotype A4, whose cells produced significantly more LTB4 than cells from controls (P value=0.0042) (Table 20). As shown in Table 20, there was also a heightened LTB4 response in males who do not carry HapA but of borderline significance. This could be explained by additional variants in the FLAP gene that have not been uncovered, or alternatively in other genes belonging to the 5-LO pathway, that may account for upregulation in the LTB4 response in some of the patients without the FLAP at-risk haplotype. As shown in Table 20, differences in LTB4 response were not detected in females. However, due to a small sample size this cannot be considered conclusive. Taken together, the elevated levels of LTB4 production of stimulated neutrophils from male carriers of the at-risk haplotype suggest that the disease associated variants in the FLAP gene increase FLAP's response to factors that stimulate inflammatory cells, resulting in increased leukotriene production and increased risk for MI.

TABLE 20

LTB4 levels after ionomycin stimulation of isolated neutrophils[a]

| Phenotype (n) | After 15 Minutes | | After 30 Minutes | |
| --- | --- | --- | --- | --- |
| | Mean (SD) | P value | Mean (SD) | P value |
| Controls (35) | 4.53 (1.00) | | 4.67 (0.88) | |
| Males (18) | 4.61 (1.10) | | 4.68 (1.07) | |
| Females (17) | 4.51 (0.88) | | 4.67 (0.62) | |
| MI (41) | 5.18 (1.09) | 0.011 | 5.24 (1.06) | 0.016 |
| Carriers (16) | 5.26 (1.09) | 0.027 | 5.27 (1.09) | 0.051 |
| Non-carriers (24) | 5.12 (1.08) | 0.040 | 5.22 (1.03) | 0.035 |
| MI males (28) | 5.37 (1.10) | 0.0033 | 5.38 (1.09) | 0.0076 |
| Carriers (10) | 5.66 (1.04) | 0.0042 | 5.58 (1.12) | 0.013 |
| Non-carriers (18) | 5.20 (1.09) | 0.039 | 5.26 (1.05) | 0.041 |
| MI females (13) | 4.78 (0.95) | 0.46 | 4.95 (0.92) | 0.36 |
| Carriers (6) | 4.59 (0.80) | 0.90 | 4.75 (0.82) | 0.85 |
| Non-carriers (7) | 4.94 (1.04) | 0.34 | 5.12 (0.96) | 0.25 |

[a]Mean ± SD of log-transformed values of LTB4 levels of ionomycin-stimulated neutrophils from MI patients and controls. Results are shown for two time points: 15 and 30 minutes. The results for males and females and for MI male and female carriers and non-carriers of the at-risk haplotype HapA are shown separately. Two-sided p values corresponding to a standard two-sample test of the difference in the mean values between the MI patients, their various sub-cohorts and the controls are shown.

EXAMPLE 8

Haplotypes Associated with MI also Confer Risk of Stroke and PAOD

Because stroke and PAOD are diseases that are closely related to MI (all occur on the basis of atherosclerosis), it was examined whether the SNP haplotype in the FLAP gene that confers risk to MI also conferred risk of stroke and/or PAOD. The 'at risk' haplotype (A4 haplotype) can be defined by the following 4 SNPs: SG13S25 with allele G, SG13S114 with allele T, SG13S89 with allele G, and SG13S32 with allele A.

Table 21 shows that the haplotype A4 increases the risk of having a stroke to a similar extent as it increases the risk of having an MI. The 'at risk' haplotype is carried by 28% of stroke patients and 17% of controls, meaning that the relative risk of having stroke for the carriers of this haplotype is 1.7 (p-value=$5.8 \cdot 10^{-06}$). Although not as significant, the 'at risk' haplotype also confers risk of having PAOD.

TABLE 21

| | p-val | r | #aff | aff. frq. | #con | con. frq. | info | SG13S25 |
| --- | --- | --- | --- | --- | --- | --- | --- | --- |
| MI haplotypes | | | | | | | | |
| All MI patients | | | | | | | | |
| A4 | 5.3E−07 | 1.80 | 1407 | 0.16 | 614 | 0.09 | 0.82 | G |
| B4 | 1.0E−04 | 1.87 | 1388 | 0.10 | 612 | 0.06 | 0.67 | G |
| Males MI | | | | | | | | |
| A4 | 2.5E−08 | 2.00 | 864 | 0.17 | 614 | 0.09 | 0.82 | G |
| B4 | 1.1E−05 | 2.12 | 852 | 0.11 | 612 | 0.06 | 0.67 | G |
| Females MI | | | | | | | | |
| A4 | 1.9E−02 | 1.44 | 543 | 0.13 | 614 | 0.09 | 0.73 | G |
| B4 | 7.9E−02 | 1.45 | 536 | 0.08 | 612 | 0.06 | 0.60 | G |
| Replication in stroke | | | | | | | | |
| All stroke patients | | | | | | | | |
| A4 | 5.8E−06 | 1.73 | 1238 | 0.15 | 614 | 0.09 | 0.80 | G |
| B4 | 2.3E−04 | 1.83 | 1000 | 0.10 | 612 | 0.06 | 0.71 | G |
| Males stroke | | | | | | | | |
| A4 | 1.1E−06 | 1.91 | 710 | 0.17 | 614 | 0.09 | 0.79 | G |
| B4 | 3.1E−05 | 2.11 | 574 | 0.11 | 612 | 0.06 | 0.72 | G |
| Females stroke | | | | | | | | |
| A4 | 9.9E−03 | 1.49 | 528 | 0.13 | 614 | 0.10 | 0.74 | G |
| B4 | 6.3E−02 | 1.47 | 426 | 0.08 | 612 | 0.06 | 0.70 | G |
| All stroke excluding MI | 8.4E−05 | 1.65 | 1054 | 0.15 | 614 | 0.09 | 0.78 | G |
| Males stroke excluding MI | 6.4E−05 | 1.78 | 573 | 0.16 | 614 | 0.09 | 0.75 | G |
| Females stroke excluding MI | 1.2E−02 | 1.49 | 481 | 0.14 | 614 | 0.10 | 0.72 | G |
| Cardioembolic stroke | 6.6E−04 | 1.87 | 248 | 0.16 | 614 | 0.10 | 0.74 | G |
| Cardioembolic stroke excluding MI | 3.8E−02 | 1.56 | 191 | 0.14 | 614 | 0.10 | 0.70 | G |
| Large vessel stroke | 8.0E−02 | 1.47 | 150 | 0.13 | 614 | 0.09 | 0.83 | G |
| Large vessel stroke excluding MI | 2.9E−01 | 1.31 | 114 | 0.12 | 614 | 0.09 | 0.80 | G |
| Small vessel stroke | 7.2E−04 | 2.05 | 166 | 0.18 | 614 | 0.09 | 0.71 | G |
| Small vessel stroke excluding MI | 1.0E−04 | 2.31 | 152 | 0.20 | 614 | 0.10 | 0.71 | G |
| Hemorrhagic stroke | 4.4E−02 | 1.73 | 97 | 0.15 | 614 | 0.09 | 0.72 | G |
| Hemorrhagic stroke excluding MI | 3.9E−02 | 1.78 | 92 | 0.16 | 614 | 0.09 | 0.71 | G |
| Unknown cause stroke | 1.3E−04 | 1.88 | 335 | 0.16 | 614 | 0.09 | 0.75 | G |

TABLE 21-continued

| | | | | | | | |
|---|---|---|---|---|---|---|---|
| Unknown cause stroke excluding MI | 6.5E−04 | 1.82 | 297 | 0.16 | 614 | 0.09 | 0.72 | G |
| MI and stroke together | | | | | | | | |
| All patients | | | | | | | | |
| Best haplo A4 | 4.1E−07 | 1.75 | 2659 | 0.15 | 614 | 0.09 | 0.82 | G |
| B4 | 4.1E−05 | 1.85 | 2205 | 0.10 | 612 | 0.06 | 0.70 | G |
| Males | | | | | | | | |
| A4 | 1.4E−08 | 1.93 | 1437 | 0.17 | 614 | 0.09 | 0.82 | G |
| B4 | 2.0E−06 | 2.11 | 1290 | 0.11 | 612 | 0.06 | 0.70 | G |
| Females | | | | | | | | |
| A4 | 3.6E−03 | 1.47 | 1024 | 0.13 | 614 | 0.09 | 0.77 | G |
| B4 | 2.8E−02 | 1.48 | 915 | 0.08 | 612 | 0.06 | 0.66 | G |
| Patients with both MI and stroke | | | | | | | | |
| A4 | 6.1E−05 | 2.10 | 184 | 0.18 | 614 | 0.09 | 0.86 | G |
| Replication in PAOD | | | | | | | | |
| All PAOD patients | 3.6E−02 | 1.31 | 920 | 0.12 | 614 | 0.10 | 0.84 | G |
| Males PAOD | 1.8E−02 | 1.40 | 580 | 0.13 | 614 | 0.10 | 0.84 | G |
| Females PAOD | 3.7E−01 | 1.17 | 340 | 0.11 | 614 | 0.10 | 0.83 | G |
| All PAOD excluding MI | 1.1E−01 | 1.24 | 750 | 0.12 | 614 | 0.10 | 0.83 | G |
| Males PAOD excluding MI | 8.3E−02 | 1.30 | 461 | 0.12 | 614 | 0.10 | 0.83 | G |
| Males PAOD excluding MI and stroke | 8.7E−02 | 1.32 | 388 | 0.12 | 614 | 0.10 | 0.83 | G |

| | SG13S106 | SG13S114 | SG13S89 | SG13S30 | SG13S32 | SG13S42 |
|---|---|---|---|---|---|---|
| MI haplotypes | | | | | | |
| All MI patients | | | | | | |
| A4 | | T | G | | A | |
| B4 | G | | | G | | A |
| Males MI | | | | | | |
| A4 | | T | G | | A | |
| B4 | G | | | G | | A |
| Females MI | | | | | | |
| A4 | | T | G | | A | |
| B4 | G | | | G | | A |
| Replication in stroke | | | | | | |
| All stroke patients | | | | | | |
| A4 | | T | G | | A | |
| B4 | G | | | G | | A |
| Males stroke | | | | | | |
| A4 | | T | G | | A | |
| B4 | G | | | G | | A |
| Females stroke | | | | | | |
| A4 | | T | G | | A | |
| B4 | G | | | G | | A |
| All stroke excluding MI | | T | G | | A | |
| Males stroke excluding MI | | T | G | | A | |
| Females stroke excluding MI | | T | G | | A | |
| Cardioembolic stroke | | T | G | | A | |
| Cardioembolic stroke excluding MI | | T | G | | A | |
| Large vessel stroke | | T | G | | A | |
| Large vessel stroke excluding MI | | T | G | | A | |
| Small vessel stroke | | T | G | | A | |
| Small vessel stroke excluding MI | | T | G | | A | |
| Hemorrhagic stroke | | T | G | | A | |
| Hemorrhagic stroke excluding MI | | T | G | | A | |
| Unknown cause stroke | | T | G | | A | |
| Unknown cause stroke excluding MI | | T | G | | A | |
| MI and stroke together | | | | | | |
| All patients | | | | | | |
| Best haplo A4 | | T | G | | A | |
| B4 | G | | | G | | A |
| Males | | | | | | |
| A4 | | T | G | | A | |
| B4 | G | | | G | | A |
| Females | | | | | | |
| A4 | | T | G | | A | |
| B4 | G | | | G | | A |

TABLE 21-continued

| Patients with both MI and stroke | | | |
|---|---|---|---|
| A4 | T | G | A |
| Replication in PAOD | | | |
| All PAOD patients | T | G | A |
| Males PAOD | T | G | A |
| Females PAOD | T | G | A |
| All PAOD excluding MI | T | G | A |
| Males PAOD excluding MI | T | G | A |
| Males PAOD excluding MI and stroke | T | G | A |

The patient cohorts used in the association analysis shown in Table 21 may include first and second degree relatives.

Table 21, discussed above, shows the results of the haplotype A4 association study using 779 MI patients, 702 stroke patients, 577 PAOD patients and 628 controls. First and second degree relatives were excluded from the patient cohorts. All known cases of MI were removed from the stroke and PAOD cohorts before testing for association. A significant association of the A4 haplotype to stroke was observed, with a relative risk of 1.67 (P value=0.000095). In addition, it was determined whether the A4 haplotype was primarily associated with a particular sub-phenotype of stroke, and found that both ischemic and hemorrhagic stroke were significantly associated with the A4 haplotype (Table 22).

TABLE 22

Association of the A4 haplotype to subgroups of stroke

| Phenotype (n) | Pat. Frq. | RR | PAR | P-value |
|---|---|---|---|---|
| Stroke[a] (702) | 0.149 | 1.67 | 0.116 | 0.000095 |
| Ischemic (484) | 0.148 | 1.65 | 0.113 | 0.00053 |
| TIA (148) | 0.137 | 1.51 | 0.090 | 0.058 |
| Hemorrhagic (68) | 0.167 | 1.91 | 0.153 | 0.024 |

[a]Excluding known cases of MI.

Finally, the A4 haplotype was less significantly associated with PAOD (Table 21). It should be noted that similar to the stronger association of the A4 haplotype to male MI compared to female MI, it also shows stronger association to male stroke and PAOD (Table 21).

Study Population

The stroke and PAOD cohorts used in this study have previously been described (Gretarsdottir, S. et al. *Nat Genet* 35, 131-8 (2003); Gretarsdottir, S. et al., *Am J Hum Genet* 70, 593-603 (2002); Gudmundsson, G. et al., *Am J Hum Genet* 70, 586-92 (2002)). For the stroke linkage analysis, genotypes from 342 male patients with ischemic stroke or TIA that were linked to at least one other male patient within and including 6 meioses in 164 families were used. For the association studies 702 patients with all forms of stroke (n=329 females and n=373 males) and 577 PAOD patients (n=221 females and n=356 males) were analysed. Patients with stroke or PAOD that also had MI were excluded. Controls used for the stroke and PAOD association studies were the same as used in the MI SNP association study (n=628).

The study was approved by the Data Protection Commission of Iceland and the National Bioethics Committee of Iceland. Informed consent was obtained from all study participants. Personal identifiers associated with medical information and blood samples were encrypted with a third party encryption system as previously described (Gulcher, J. R., Kristjansson, K., Gudbjartsson, H. & Stefansson, K., *Eur J Hum Genet* 8, 739-42 (2000)).

Figure 5:
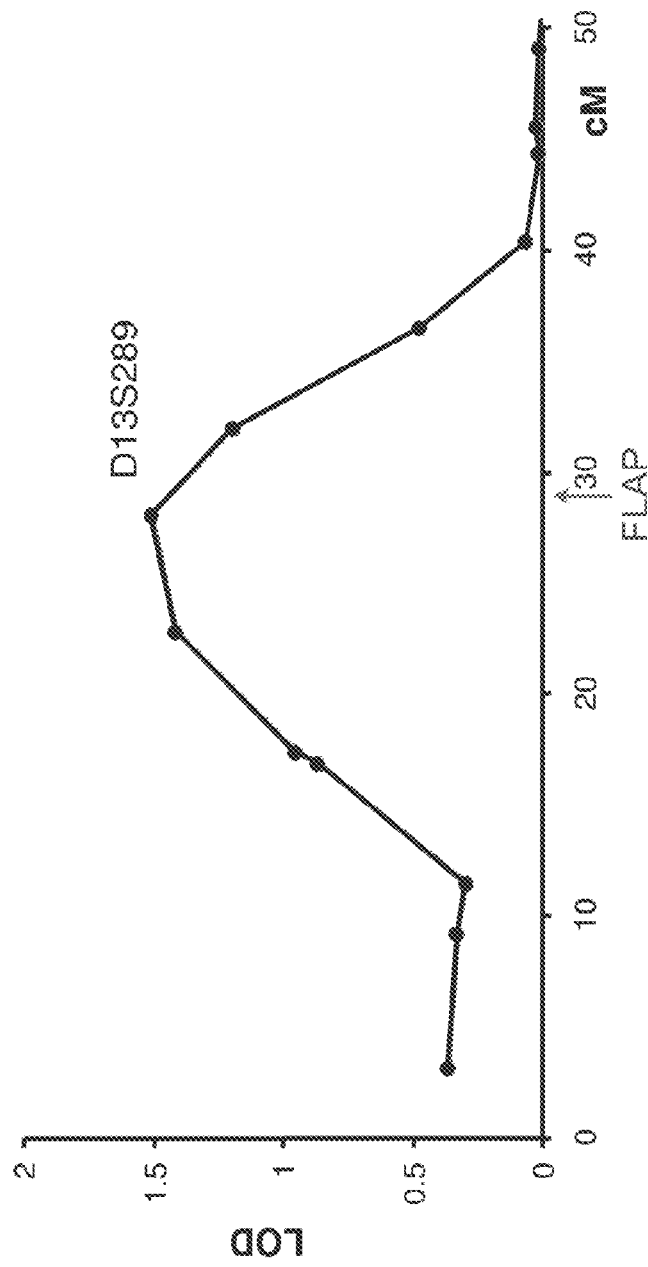
FIG. 5 shows a linkage scan using framework microsatellite markers on chromosome 13 for male patients with ischemic stroke or TIA (n=342 in 164 families at 6 meiosis). The LOD score is expressed on the y axis and the distance from the pter in Kosambi cM on the x axis.

In addition, in an independent linkage study of male patients with ischemic stroke or transient ischemic attack, linkage to the same locus was observed with a LOD score of 1.51 at the same peak marker (FIG. 5), further suggested that a cardiovascular susceptibility factor might reside at this locus.

EXAMPLE 9

Haplotype Association to FLAP in a British Cohort

In an independent study, it was determined whether variants in the FLAP gene also have impact on risk of MI in a population outside Iceland. The four SNPs, defining the A4 haplotype, were typed in a cohort of 750 patients from the United Kingdom who had sporadic MI, and in 728 British population controls. The patients and controls come from 3 separate study cohorts recruited in Leicester and Sheffield. No significant differences were found in the frequency of the haplotype between patients and controls (16.9% versus 15.3%, respectively). However, when an additional 9 SNPs, distributed across the FLAP gene, were typed in the British cohort and searched for other haplotypes that might be associated with MI, two SNPs showed association to MI with a nominally significant P value (data not shown). Moreover, three and four SNP haplotype combinations increased the risk of MI in the British cohort further and the most significant association was observed for a four SNP haplotype with a nominal P value=0.00037 (Table 23).

TABLE 23

Association of the HapB haplotype to British MI patients

| Phenotype (n) | Frq. Pat. | RR | PAR | P-value | P-value[a] |
|---|---|---|---|---|---|
| MI (750) | 0.075 | 1.95 | 0.072 | 0.00037 | 0.046 |
| Males (546) | 0.075 | 1.97 | 0.072 | 0.00093 | ND |
| Females (204) | 0.073 | 1.90 | 0.068 | 0.021 | ND |

[a]P value adjusted for the number of haplotypes tested using 1,000 randomization tests.
Shown are the results for HapB that shows the strongest association in British MI cohort. HapB is defined by the following SNPs: SG13S377, SG13S114, SG13S41 and SG13S35 (that have the following alleles A, A, A and G, respectively. In all three phenotypes shown the same set of n = 728 British controls is used and the frequency of HapB in the control cohort is 0.040. Number of patients (n), haplotype frequency in patients (Frq. pat.), relative risk (RR) and population attributed risk (PAR).

This was called haplotype HapB. The haplotype frequency of HapB is 7.5% in the MI patient cohort (carrier frequency 14.4%), compared to 4.0% (carrier frequency 7.8%) in controls, conferring a relative risk of 1.95 (Table 23). This haplotype remained significant after adjusting for all haplotypes tested, using 1000 randomisation steps, with an adjusted P value=0.046. No other SNP haplotype had an adjusted P value less than 0.05. The two at-risk haplotypes A4 and HapB appear to be mutually exclusive with no instance where the same chromosome carries both haplotypes.

British Study Population

The method of recruitment of 3 separate cohorts of British subjects has been described previously (Steeds, R., Adams, M., Smith, P., Channer, K. & Samani, N. J., *Thromb Haemost* 79, 980-4 (1998); Brouilette, S., Singh, R. K., Thompson, J. R., Goodall, A. H. & Samani, N. J., *Arterioscler Thromb Vasc Biol* 23, 842-6 (2003)). In brief, in the first two cohorts a total of 547 patients included those who were admitted to the coronary care units (CCU) of the Leicester Royal Infirmary, Leicester (July 1993-April 1994) and the Royal Hallamshire Hospital, Sheffield (November 1995-March 1997) and satisfied the World Health Organization criteria for acute MI in terms of symptoms, elevations in cardiac enzymes or electrocardiographic changes (Nomenclature and criteria for diagnosis of ischemic heart disease. Report of the Joint International Society and Federation of Cardiology/World Health Organization task force on standardization of clinical nomenclature. *Circulation* 59, 607-9 (1979)). A total of 530 control subjects were recruited in each hospital from adult visitors to patients with non-cardiovascular disease on general medical, surgical, orthopaedic and obstetric wards to provide subjects likely to be representative of the source population from which the subjects originated. Subjects who reported a history of coronary heart disease were excluded.

In the third cohort, 203 subjects were recruited retrospectively from the registries of 3 coronary care units in Leicester. All had suffered an MI according to WHO criteria before the age of 50 years. At the time of participation, patients were at least 3 months from the acute event. The control cohort comprised 180 subjects with no personal or family history of premature coronary heart disease, matched for age, sex, and current smoking status with the cases. Control subjects were recruited from 3 primary care practices located within the same geographical area. In all cohorts subjects were white of Northern European origin.

Discussion

These results show that variants of the gene encoding FLAP associate with increased risk of MI and stroke. In the Icelandic cohort, a haplotype that spans the FLAP gene is carried by 30% of all MI patients and almost doubles the risk of MI. These findings were subsequently replicated in an independent cohort of stroke patients. In addition, another haplotype that spans the FLAP gene is associated with MI in a British cohort. Suggestive linkage to chromosome 13q12-13 was observed with several different phenotypes, including female MI, early onset MI of both sexes, and ischemic stroke or TIA in males. However, surprisingly, the strongest haplotype association was observed to males with MI or stroke. Therefore, there may be other variants or haplotypes within the FLAP gene, or in other genes within the linkage region, that also may confer risk to these cardiovascular phenotypes.

These data also show that the at-risk haplotype of the FLAP gene has increased frequency in all subgroups of stroke, including ischemic, TIA, and hemorrhagic stroke. Of interest is that the A4 haplotype confers significantly higher risk of MI and stroke than it does of PAOD. This could be explained by differences in the pathogenesis of these diseases. Unlike PAOD patients who have ischemic legs because of atherosclerotic lesions that are responsible for gradually diminishing blood flow to the legs, the MI and stroke patients have suffered acute events, with disruption of the vessel wall suddenly decreasing blood flow to regions of the heart and the brain.

Association was not found between the A4 haplotype and MI in a British cohort. However, significant association to MI was found with a different variant spanning the FLAP gene. The fact that different haplotypes of the gene are found conferring risk to MI in a second population is not surprising. A common disease like MI associates with many different mutations or sequence variations, and the frequencies of these disease associated variants may differ between populations. Furthermore, the same mutations may be seen arising on different haplotypic backgrounds.

In summary, it has been found that: MI correlates with genetic variation at FLAP; MI correlates with high expression promoter polymorphism at 5-LO; patients with female MI at-risk FLAP haplotypes have higher levels of serum LTE4; LTE4 levels correlate with CRP levels in serum; and patients with MI at-risk FLAP haplotypes have elevated CRP. In addition, we have shown that isolated neutrophils from MI patients, produce more LTB4 when stimulated with ionomycin compared to controls. Taken together, these results show that increased leukotriene synthesis is a risk factor for MI, and that this risk is driven in part by variants in FLAP and 5-LO genes and are captured in part by measurement of levels of serum LTE4 and CRP. Furthermore, the SNP haplotype in the FLAP gene that confers risk to MI also confers risk of stroke and/or PAOD.

Markers Utilized Herein

TABLE 24

Basepair position of microsatellite markers (start and stop of the amplimersin NCBI sequence assembly build 34 and primer sequences (forward and reverse).

| Marker name | forward primer | reverse primer | basepair start position | basepair stop position |
|---|---|---|---|---|
| DG13S2393 | CCTTTGCTTTGTTCCTATTTCTTT (SEQ ID NO.4) | TCCCATTGCCCAGAGTTAAT (SEQ ID NO. 5) | 22831401 | 22831787 |
| DG13S2070 | TCCTCATGTCTTCACCTAGAAGC (SEQ ID NO. 6) | CCACTCATGAGGGAGCTGTT (SEQ ID NO. 7) | 23020439 | 23020651 |
| DG13S2071 | TGTCACAGGCACACACTCTCT (SEQ ID NO. 8) | GAGTATGGCTGCTGCTCCTC (SEQ ID NO. 9) | 23066973 | 23067076 |

TABLE 24-continued

Basepair position of microsatellite markers (start and stop of the amplimers in NCBI sequence assembly build 34 and primer sequences (forward and reverse).

| Marker name | forward primer | reverse primer | basepair start position | basepair stop position |
|---|---|---|---|---|
| DG13S2072 | ATGGCTCACACTGGCCTAAA (SEQ ID NO. 10) | TGAACAGACCAATAATAGTGCAG (SEQ ID NO. 11) | 23136964 | 23137114 |
| DG13S2078 | AAGCCACCCTTTAAACAGCA (SEQ ID NO. 12) | GCTGAGGAAGCAACTCCACT (SEQ ID NO. 13) | 23591927 | 23592081 |
| DG13S2079 | GCTCTGAATTCCCTGGCATA (SEQ ID NO. 14) | TTAGCCCTAGTCCCACTCTCC (SEQ ID NO. 15) | 23646974 | 23647183 |
| DG13S2082 | CAAGAGGCCTGCATAAGGAA (SEQ ID NO. 16) | AGATTGCCGGTGGCTTAAAT (SEQ ID NO. 17) | 23807898 | 23808174 |
| DG13S2083 | TGTCTGTTCCCGTCTGTCTG (SEQ ID NO. 18) | TTCATCCTCTGCCAAATTCC (SEQ ID NO. 19) | 23882291 | 23882532 |
| DG13S2086 | GGCATGTATTCACTGCCTGA (SEQ ID NO. 20) | AAACCCATTCTTCTTCCTCTTAC (SEQ ID NO. 21) | 24069346 | 24069771 |
| DG13S2089 | TATGTGTTCAGCCCAGACCTC (SEQ ID NO. 22) | CCCTGCCATGTGCATTTAC (SEQ ID NO. 23) | 24274920 | 24275129 |
| DG13S44 | CATTTCGGAAGGCAAAGAAA (SEQ ID NO. 24) | TTGCAATGAGGAATGAAGCA (SEQ ID NO. 25) | 24413148 | 24413382 |
| DG13S2095 | TCCATTATCCATCTGTTCATTCA (SEQ ID NO. 26) | GAAGAATTAATTGTAGGAGGCAAGA (SEQ ID NO. 27) | 24621830 | 24622121 |
| DG13S46 | CTGACATCACCACATTGATCG (SEQ ID NO. 28) | CATACACAGCCATGTGGAATTA (SEQ ID NO. 29) | 24652046 | 24652291 |
| DG13S2101 | ACGGTGATGACGCCTACATT (SEQ ID NO. 30) | TCACATGGACCAATTACCTAGAA (SEQ ID NO. 31) | 24863557 | 24863744 |
| D13S1254 | AAATTACTTCATCTTGACGATAACA (SEQ ID NO. 32) | CTATTGGGGACTGCAGAGAG (SEQ ID NO. 33) | 25316434 | 25316657 |
| DG13S55 | AGCCAGTGTCCACAAGGAAG (SEQ ID NO. 34) | GAGGGTGAGACACATCTCTGG (SEQ ID NO. 35) | 25337471 | 25337753 |
| DG13S54 | AATCGTGCCTCAGTTCCATC (SEQ ID NO. 36) | CCACCAGGAACAACACACAC (SEQ ID NO. 37) | 25377308 | 25377463 |
| D13S625 | TTGCTCTCCAGCCTGGGC (SEQ ID NO. 38) | TTCCTCTGGCTGCCTGCG (SEQ ID NO. 39) | 25391207 | 25391395 |
| DG13S2695 | TCCTGCATGAGAAGGAACTG (SEQ ID NO. 40) | CGACATTCACTGTGGCTCTT (SEQ ID NO. 41) | 25415551 | 25415807 |
| DG13S1479 | TTTGATTCCGTGGTCCATTA (SEQ ID NO. 42) | TTATTTGGTCGGTGCACCTTT (SEQ ID NO. 43) | 25459039 | 25459368 |
| DG13S2696 | GGTGCACCGACCAAATAAGT (SEQ ID NO. 44) | CCAGCTTATTCTCTCTGCCTTC (SEQ ID NO. 45) | 25459351 | 25459478 |
| DG13S1440 | GGTAGGTTGAAATGGGCTAACA (SEQ ID NO. 46) | TCATGACAAGGTGTTGGATTT (SEQ ID NO. 47) | 25520858 | 25520987 |
| DG13S1890 | CCTCCTCTGCCATGAAGCTA (SEQ ID NO. 48) | CTATTTGGTCTGCGGGTTGT (SEQ ID NO. 49) | 25672727 | 25673140 |
| DG13S1540 | TACTGGGTTATCGCCTGACC (SEQ ID NO. 50) | CCAATGGACCTCTTGGACAT (SEQ ID NO. 51) | 25704358 | 25704504 |
| DG13S59 | TTTCGGCACAGTCCTCAATA (SEQ ID NO. 52) | CAGCTGGGTGTGGTGACAT (SEQ ID NO. 53) | 25720194 | 25720421 |
| DG13S1545 | CAGAGAGGAACAGGCAGAGG (SEQ ID NO. 54) | AGTGGCTGGGAAGCCTTATT (SEQ ID NO. 55) | 25760018 | 25760404 |
| DG13S1524 | AGGTGAGAGAACAAACCTGTCTT (SEQ ID NO. 56) | GCCTTCCTTCTAAGGCCAAC (SEQ ID NO. 57) | 25843657 | 25843768 |

TABLE 24-continued

Basepair position of microsatellite markers (start and stop of the amplimersin NCBI sequence assembly build 34 and primer sequences (forward and reverse).

| Marker name | forward primer | reverse primer | basepair start position | basepair stop position |
|---|---|---|---|---|
| DG13S1529 | CTGTAGACTTTATCCCTGACTTACTG (SEQ ID NO. 58) | CAATGAATGATGAAGATTCCACTC (SEQ ID NO. 59) | 26098943 | 26099063 |
| DG13S1908 | TGACACCATGTCTTACTGTTTGC (SEQ ID NO. 60) | GAGGATACAATGAGAACCAAATCTC (SEQ ID NO. 61) | 26110282 | 26110493 |
| DG13S2525 | CAGGATCATCAGCCAGGTTT (SEQ ID NO. 62) | GCTGCATGTCACTAGGCATT (SEQ ID NO. 63) | 26123233 | 26123381 |
| DG13S1546 | CCACAGAATGCTCCAAAGGT (SEQ ID NO. 64) | GAGTTCAAGTGATGGATGACGA (SEQ ID NO. 65) | 26159644 | 26159995 |
| DG13S1444 | CAGATAGATGAATAGGTGGATGGA (SEQ ID NO. 66) | CACTGTTCCAAGTGCTTTGC (SEQ ID NO. 67) | 26207544 | 26207727 |
| DG13S66 | TATGCGTTGTGTGTGCTGTG (SEQ ID NO. 68) | GGGCCTTAGATTCTTGTAGTGG (SEQ ID NO. 69) | 26279746 | 26279962 |
| DG13S1907 | TGTCCAGACTGCCTCCTACA (SEQ ID NO. 70) | TGCAACACCTGGTTCACAAT (SEQ ID NO. 71) | 26378401 | 26378521 |
| DG13S68 | TTTGCGAGTCCTTGTGGAGT (SEQ ID NO. 72) | ACAGTCCGCTCCCTCCTAAT (SEQ ID NO. 73) | 26511587 | 26511825 |
| DG13S69 | ATGCTTGGCCCTCAGTTT (SEQ ID NO. 74) | TTGGCAACCCAAGCTAATATG (SEQ ID NO. 75) | 26518188 | 26518483 |
| D13S1250 | CTCCACAGTGACAGTGAGG (SEQ ID NO. 76) | GAGAGGTTCCCAATCCC (SEQ ID NO: 77) | 26721525 | 26721686 |
| DG13S574 | CAGCTCCTGGCCATATTTCT (SEQ ID NO. 78) | GAGCCATTTCTCTGGGTCTG (SEQ ID NO. 79) | 26853541 | 26853693 |
| DG13S73 | GGTCCGTGTCAACCCTTAGA (SEQ ID NO. 80) | CAGGTTGATGGGAGGGAAA (SEQ ID NO. 81) | 26878938 | 26879133 |
| DG13S1532 | CGGGAAATGACAGTGAGACC (SEQ ID NO. 82) | TGCCTAGATTCTCCCGTAAG (SEQ ID NO. 83) | 26899505 | 26899652 |
| D13S1242 | GTGCCCAGCCAGATTC (SEQ ID NO. 84) | GCCCCCAGTCAGGTTT (SEQ ID NO. 85) | 26943073 | 26943316 |
| DG13S576 | TTTCTCTCTCCACGGAATGAA (SEQ ID NO. 86) | AACCCATTCTCACAGGGTGTA (SEQ ID NO. 87) | 27121599 | 27121797 |
| DG13S1917 | AGGAGTGTGGCAGCTTTGAG (SEQ ID NO. 88) | TGGATTCCCGTGAGTACCAG (SEQ ID NO. 89) | 27135092 | 27135232 |
| D13S217 | ATGCTGGGATCACAGGC (SEQ ID NO. 90) | AACCTGGTGGACTTTTGCT (SEQ ID NO. 91) | 27169880 | 27170051 |
| DG13S581 | AGCATTTCCAATGGTGCTTT (SEQ ID NO. 92) | CATGTTGATATGCCTGAAGGA (SEQ ID NO. 93) | 27318359 | 27318725 |
| DG13S1471 | CACTGTCTGCTGCCACTCAT (SEQ ID NO. 94) | AGAGATTATGTGATGTACCCTCTCTAT (SEQ ID NO. 95) | 27403303 | 27403544 |
| DG13S2505 | TGATGAAGATCTGGGCGTTA (SEQ ID NO. 96) | TGCCTGTGCTCACTCACTCT (SEQ ID NO. 97) | 27493479 | 27493626 |
| D13S120 | ATGACCTAGAAATGATACTGGC (SEQ ID NO. 98) | CAGACACCACAACACACATT (SEQ ID NO. 99) | 27540983 | 27541093 |
| D13S1486 | TGGTTTAAAAACCTCATGCC (SEQ ID NO. 100) | ATCCCAAACTCTGTACTTATGTAGG (SEQ ID NO. 101) | 27623349 | 27623496 |
| DG13S1495 | CCTTGGCTGTTGTGACTGGT (SEQ ID NO. 102) | CACTCAGGTGGGAGGATCAC (SEQ ID NO. 103) | 27668199 | 27668471 |
| DG13S1845 | CACTTTGCCAGTAGCCTTGA (SEQ ID NO. 104) | TTGGGAAAGTTAACCCAGAGA (SEQ ID NO. 105) | 27788787 | 27789056 |

TABLE 24-continued

Basepair position of microsatellite markers (start and stop of the amplimersin NCBI sequence assembly build 34 and primer sequences (forward and reverse).

| Marker name | forward primer | reverse primer | basepair start position | basepair stop position |
|---|---|---|---|---|
| DG13S1030 | TTTGGGAAGAGCCATGAGAC (SEQ ID NO. 106) | CTCTGGGCATTGGAGGATTA (SEQ ID NO. 107) | 27872811 | 27873164 |
| DG13S584 | GGGAGACAAGTCAGGTGAGG (SEQ ID NO. 108) | CTGAGTATGGAGTCTTCATCATTATC (SEQ ID NO. 109) | 27924334 | 27924484 |
| DG13S79 | TGCTACTAGATTTGACCAACCA (SEQ ID NO. 110) | GACTTGTAAAGGATTTAGTGATTTCG (SEQ ID NO. 111) | 28213368 | 28213495 |
| DG13S80 | GTGGAAGGCCTCTCTCTGTG (SEQ ID NO. 112) | TGCTTCTTGAGGGAAAGCAT (SEQ ID NO. 113) | 28297121 | 28297353 |
| DG13S1934 | CCTTCAGAGGATTTCCCTTTC (SEQ ID NO. 114) | CTGGTTTGACTCCAGCTTCA (SEQ ID NO. 115) | 28461787 | 28462194 |
| DG13S1104 | CCTGGCACGGAATAGACACT (SEQ ID NO. 116) | GGCCTCCTTTGCTCTGAAG (SEQ ID NO. 117) | 28497694 | 28498071 |
| DG13S1097 | CATCCCTGTGGCTGATTAAGA (SEQ ID NO. 118) | AACAGTTCCAGCCCGTTCTA (SEQ ID NO. 119) | 28532382 | 28532543 |
| DG13S1110 | TTTCAAAGGAATATCCAAGTGC (SEQ ID NO. 120) | TGGCGTACCATATAAACAGTTCTC (SEQ ID NO. 121) | 28547636 | 28547900 |
| DG13S87 | TTCAATGAAGGTGCCGAAGT (SEQ ID NO. 122) | TGTCTATCCCAAAGCTGCAA (SEQ ID NO. 123) | 28597688 | 28597905 |
| DG13S2400 | GCTCAGTCCAAGTTCATGCTC (SEQ ID NO. 124) | TGGGATTGGGTTCTGGATAC (SEQ ID NO. 125) | 28671947 | 28672231 |
| DG13S3114 | CCTACTTTCCATCTCCTCCTTG (SEQ ID NO. 126) | TGGAGTAAGTTGGAGAATTGTTGA (SEQ ID NO. 127) | 28678081 | 28678248 |
| DG13S1111 | GCAAGACTCTGTTGAAGAAGAAGA (SEQ ID NO. 128) | TCCCTCTGTTTGAGTTTCTCG (SEQ ID NO. 129) | 28760422 | 28760531 |
| DG13S3122 | CCTTGGGCAGTCAGAGAAAC (SEQ ID NO. 130) | CCCGTGAAGTCTGAGAGGTG (SEQ ID NO. 131) | 28778662 | 28778906 |
| DG13S1101 | AGGCACAGTCGCTCATGTC (SEQ ID NO. 132) | AAACTTTAGCTAATGGTGGTCAAA (SEQ ID NO. 133) | 28812542 | 28812874 |
| D13S1246 | GAGCATGTGTGACTTTCATATTCAG (SEQ ID NO. 134) | AGTGGCTATTCATTGCTACAGG (SEQ ID NO. 135) | 28903534 | 28903738 |
| DG13S1103 | TTGCTGGATGCTGGTTTCTA (SEQ ID NO. 136) | AAAGAGAGAGAGAAAGAGAAAGAAAGA (SEQ ID NO. 137) | 28910502 | 28910765 |
| DG13S3147 | AAAGTGGATGCAGTTGAGGTTT (SEQ ID NO. 138) | GCTAGCCATTACAGACAACCAA (SEQ ID NO. 139) | 29018341 | 29018591 |
| DG13S3150 | CAGGGCTCCATGTATCCATAA (SEQ ID NO. 140) | CAATCTTTGGCTTTGGGTTT (SEQ ID NO. 141) | 29042766 | 29042948 |
| D13S289 | CTGGTTGAGCGGCATT (SEQ ID NO. 142) | TGCAGCCTGGATGACA (SEQ ID NO. 143) | 29063702 | 29063949 |
| DG13S166 | CCTATGGAAGCATAGGGAAGAA (SEQ ID NO. 144) | CCCACTTCTGAGTCTCCTGAT (SEQ ID NO. 145) | 29064359 | 29064753 |
| DG13S3156 | GGGAAATGGAGCTGCTGTTA (SEQ ID NO. 146) | GAGTGGGTGAGTGCAAGGAT (SEQ ID NO. 147) | 29111037 | 29111416 |
| D13S1238 | CTCTCAGCAGGCATCCA (SEQ ID NO. 148) | GCCAACGTAATTGACACCA (SEQ ID NO. 149) | 29144427 | 29144579 |
| DG13S2605 | TGAAAGGAAGGTCCCTGAGTT (SEQ ID NO. 150) | CCCTGCTTTGCACAAGTTATC (SEQ ID NO 151) | 29145896 | 29146055 |
| DG13S163 | CACATGAGGCTGTATGTGGA (SEQ ID NO. 152) | TGTGCAGGAATGAGAAGTCG (SEQ ID NO. 153) | 29177152 | 29177313 |

TABLE 24-continued

Basepair position of microsatellite markers (start and stop of the amplimers in NCBI sequence assembly build 34 and primer sequences (forward and reverse).

| Marker name | forward primer | reverse primer | basepair start position | basepair stop position |
|---|---|---|---|---|
| D13S290 | CCTTAGGCCCCATAATCT (SEQ ID NO. 154) | CAAATTCCTCAATTGCAAAT (SEQ ID NO. 155) | 29227323 | 29227512 |
| D13S1229 | GGTCATTCAGGGAGCCATTC (SEQ ID NO. 156) | CCATTATATTTCACCAAGAGGCTGC (SEQ ID NO. 157) | 29282262 | 29282396 |
| DG13S2358 | AGTCAAGGCTGACAGGGAAG (SEQ ID NO. 158) | GCTCTCAGCCCTCAATGTGT (SEQ ID NO. 159) | 29342275 | 29342399 |
| DG13S2658 | ATTTGGGTTCCTCTCCCAAT (SEQ ID NO. 160) | ACAAACTCTTGCTGCTGGTG (SEQ ID NO. 161) | 29348162 | 29348426 |
| DG13S1460 | TGCCTGGTCATCTACCCATT (SEQ ID NO. 162) | TCTACTGCAGCGCTGATCTT (SEQ ID NO. 163) | 29389048 | 29389297 |
| DG13S2434 | TCCTTCCAGAAGGTTTGCAT (SEQ ID NO. 164) | TGCAAAGTTGTTCAAGAGAGACA (SEQ ID NO. 165) | 29485254 | 29485392 |
| DG13S1448 | CAGCAGGAAGATGGACAGGT (SEQ ID NO. 166) | CACACTGCATCACACATACCC (SEQ ID NO. 167) | 29499404 | 29499531 |
| D13S1287 | TATGCCAGTATGCCTGCT (SEQ ID NO. 168) | GTCACATCAGTCCATTTGC (SEQ ID NO. 169) | 29513830 | 29514063 |
| DG13S2665 | GGTTTATGTCTGTGTGTGTGC (SEQ ID NO. 170) | TGAGGGATGTCAGAGAAATATGC (SEQ ID NO. 171) | 29747845 | 29747984 |
| DG13S1904 | TGATGAAATTGCCTAGTGATGC (SEQ ID NO. 172) | GGATCCAATCGTACGCTACC (SEQ ID NO. 173) | 29767797 | 29767922 |
| DG13S1490 | ACCTAAACACCACGGACTGG (SEQ ID NO. 174) | CAGGTATCGACATTCTTCCAAA (SEQ ID NO. 175) | 29908555 | 29908958 |
| DG13S2637 | GGTGATCTAGGGAATTATTTGTCTTC (SEQ ID NO. 176) | TTGGCCACTAAGGTCCAGAT (SEQ ID NO. 177) | 29941956 | 29942120 |
| DG13S96 | CCTTTGAGGCTGGATCTGTT (SEQ ID NO. 178) | TTTCCTTATCATTCATTCCCTCA (SEQ ID NO. 179) | 30166433 | 30166650 |
| D13S260 | AGATATTGTCTCCGTTCCATGA (SEQ ID NO. 180) | CCCAGATATAAGGACCTGGCTA (SEQ ID NO. 181) | 30234833 | 30234997 |
| DG13S17 | TTTAAGCCCTGTGGAATGTATTT (SEQ ID NO. 182) | GACATTGCAGGTCAAGTAGGG (SEQ ID NO. 183) | 30288392 | 30288544 |
| DG13S306 | TGCATAAGGCTGGAGACAGA (SEQ ID NO. 184) | CACAGCAGATGGGAGCAAA (SEQ ID NO. 185) | 30404049 | 30404203 |
| DG13S2486 | AGCCAGTTGTCTTTCATCCTG (SEQ ID NO. 186) | TGCCTGTGCTTGTATATTCTGTG (SEQ ID NO. 187) | 30411508 | 30411755 |
| DG13S18 | GTGCATGTGCATACCAGACC (SEQ ID NO. 188) | GGCAAGATGACCTCTGGAAA (SEQ ID NO. 189) | 30456875 | 30457193 |
| DG13S1062 | TTTGTGTTCCAGGTGAGAATTG (SEQ ID NO. 190) | GAACCATATCCCAAGGCACT (SEQ ID NO. 191) | 30551596 | 30551715 |
| DG13S1093 | TTGTTCCCACATTCATTCTACA (SEQ ID NO. 192) | TTAAACTCGTGGCAAAGACG (SEQ ID NO. 193) | 30625918 | 30626190 |
| DG13S1059 | CACCATGCCTGGCTCTTT (SEQ ID NO. 194) | AACTTCTCCAGTTGTGTGGTTG (SEQ ID NO. 195) | 30822917 | 30823246 |
| D13S171 | CCTACCATTGACACTCTCAG (SEQ ID NO. 196) | TAGGGCCATCCATTCT (SEQ ID NO. 197) | 31051937 | 31052167 |
| DG13S2359 | TCTGTGTGTATTGTGTACTCCTCTG (SEQ ID NO. 198) | TCACACAATTTGAACCAATCCT (SEQ ID NO. 199) | 31073673 | 31073849 |
| DG13S1092 | ACCAAGATATGAAGGCCAAA (SEQ ID NO. 200) | CCTCCAGCTAGAACAATGTGAA (SEQ ID NO. 201) | 31113759 | 31113934 |

TABLE 24-continued

Basepair position of microsatellite markers (start and stop of the amplimers in NCBI sequence assembly build 34 and primer sequences (forward and reverse).

| Marker name | forward primer | reverse primer | basepair start position | basepair stop position |
|---|---|---|---|---|
| DG13S2629 | TGATCATGTCAGCAGCAGAAG (SEQ ID NO. 202) | AGTAACAGGTGAGGGCATGG (SEQ ID NO. 203) | 31179791 | 31179953 |
| DG13S1449 | TGTCCATAGCTGTAGCCCTGT (SEQ ID NO. 204) | CTCAATGGGCATCTTTAGGC (SEQ ID NO. 205) | 31199228 | 31199498 |
| DG13S312 | CAAACAAACAAACAAGCAAACC (SEQ ID NO. 206) | TGGACGTTTCTTTCAGTGAGG (SEQ ID NO. 207) | 31280202 | 31280550 |
| DG13S1511 | TGATAACTTACCAGCATGTGAGC (SEQ ID NO. 208) | TCACCTCACCTAAGGATCTGC (SEQ ID NO. 209) | 31321562 | 31321854 |
| DG13S2454 | GCTAGCAAATCTCTCAACTTCCA (SEQ ID NO. 210) | TCTTCTCCATGCTGCTTCCT (SEQ ID NO. 211) | 31352662 | 31352803 |
| DG13S314 | CATGCAATTGCCCAATAGAG (SEQ ID NO. 212) | TTGGGCTTGTCTACCTAGTTCA (SEQ ID NO. 213) | 31379760 | 31380086 |
| DG13S1071 | GCTGCACGTATTTGTTGGTG (SEQ ID NO. 214) | AAACAGCAGAAATGGGAACC (SEQ ID NO. 215) | 31447431 | 31447669 |
| DG13S1068 | CCGTGGGCTATCAATTTCTG (SEQ ID NO. 216) | AAGATGCAATCTGGTTTCCAA (SEQ ID NO. 217) | 31553333 | 31553570 |
| DG13S1077 | CCCAAGACTGAGGAGGTCAA (SEQ ID NO. 218) | GCTGACGGAGAGGAAAGAGA (SEQ ID NO. 219) | 31569360 | 31569733 |
| DG13S2343 | TCACAAAGCAAGCAATCACA (SEQ ID NO. 220) | TGATGGATGCACCATGTTTA (SEQ ID NO. 221) | 31653489 | 31653608 |
| DG13S316 | TGAGAAGCCTGGGCATTAAG (SEQ ID NO. 222) | ACAAGCTCATCCAGGGAAAG (SEQ ID NO. 223) | 31708002 | 31708244 |
| DG13S1558 | AGAGCTGATCTGGCCGAAG (SEQ ID NO. 224) | GGTGGACACAGAATCCACACT (SEQ ID NO. 225) | 31986248 | 31986627 |
| D13S267 | GGCCTGAAAGGTATCCTC (SEQ ID NO. 226) | TCCCACCATAAGCACAAG (SEQ ID NO. 227) | 32062233 | 32062380 |
| DG13S1478 | TCAACCTAGGATTGGCATTACA (SEQ ID NO. 228) | TCTAGGATTTGTGCCTTTCCA (SEQ ID NO. 229) | 32157761 | 32158137 |
| DG13S1551 | ATTCGTGCAGCTGTTTCTGC (SEQ ID NO. 230) | GCATGACATTGTAAATGGAGGA (SEQ ID NO. 231) | 32364898 | 32365153 |
| DG13S1884 | GGTGGGAATGTGTGACTGAA (SEQ ID NO. 232) | CCAGGTACAACATTCTCCTGAT (SEQ ID NO. 233) | 32451203 | 32451315 |
| D13S1293 | TGCAGGTGGGAGTCAA (SEQ ID NO. 234) | AAATAACAAGAAGTGACCTTCCTA (SEQ ID NO. 235) | 32536337 | 32536467 |
| DG13S1518 | AAAGGATGCATTCGGTTAGAG (SEQ ID NO. 236) | ACTGTCCTGTGCCTGTGCTT (SEQ ID NO. 237) | 32588965 | 32589321 |
| D13S620 | GTCCACCTAATGGCTCATTC (SEQ ID NO. 238) | CAAGAAGCACTCATGTTTGTG (SEQ ID NO. 239) | 32627749 | 32627947 |
| DG13S1866 | AGCCTGTGATTGGCTGAGA (SEQ ID NO. 240) | GGCTTACAGCTGCCTCCTTT (SEQ ID NO. 241) | 32633306 | 32633709 |
| DG13S1927 | CCCACAGAGCACTTTGTTAGA (SEQ ID NO. 242) | GCCTCCCTTAAGCTGTTATGC (SEQ ID NO. 243) | 32691932 | 32692304 |
| DG13S1503 | CACTCTTTACTGCCAATCACTCC (SEQ ID NO. 244) | GCCGTGTGGGTGTATGAAT (SEQ ID NO. 245) | 32699827 | 32700058 |
| DG13S332 | TTGTACCAGGAACCAAAGACAA (SEQ ID NO. 246) | CACAGACAGAGGCACATTGA (SEQ ID NO. 247) | 32764576 | 32764751 |
| DG13S333 | GCTCTGGTCACTCCTGCTGT (SEQ ID NO. 248) | CATGCCTGGCTGATTGTTT (SEQ ID NO. 249) | 32872275 | 32872720 |

TABLE 24-continued

Basepair position of microsatellite markers (start and stop of the amplimers in NCBI sequence assembly build 34 and primer sequences (forward and reverse).

| Marker name | forward primer | reverse primer | basepair start position | basepair stop position |
|---|---|---|---|---|
| D13S220 | CCAACATCGGGAACTG (SEQ ID NO. 250) | TGCATTCTTTAAGTCCATGTC (SEQ ID NO. 251) | 32967602 | 32967793 |
| DG13S1919 | CAGCAACTGACAACTCATCCA (SEQ ID NO. 252) | CCTCAATCCTCAGCTCCAAC (SEQ ID NO. 253) | 33014255 | 33014477 |
| DG13S2383 | TGATTGGTTCTGTTGTTGCTG (SEQ ID NO. 254) | AGCCCAAGGCTCTTGTGAG (SEQ ID NO. 255) | 33053369 | 33053553 |
| DG13S1439 | TCCTTCACAGCTTCAAACTCA (SEQ ID NO. 256) | AGTGAGAAGCTTCCATACTGGT (SEQ ID NO. 257) | 33070030 | 33070264 |
| DG13S335 | GCCAACCGTTAGACAAATGA (SEQ ID NO. 258) | CTACATGTGCACCACAACACC (SEQ ID NO. 259) | 33102278 | 33102478 |
| DG13S340 | AGTTTATTGCCGCCGAGAG (SEQ ID NO. 260) | ACCCACCACATTCACAAGC (SEQ ID NO. 261) | 33124866 | 33125238 |
| DG13S1496 | CGATTGCCATGTCTCTTTGA (SEQ ID NO. 262) | GAGATCTGGCCTGGATTTGT (SEQ ID NO. 263) | 33215915 | 33216066 |
| DG13S347 | TCATTGTCAGCACAGAATGAACT (SEQ ID NO. 264) | GGAGGGAGGGAAGAAAGAGA (SEQ ID NO. 265) | 33280351 | 33280688 |
| DG13S339 | GGGAAGAGGAGATTGACTTGTT (SEQ ID NO. 266) | GGAACACCATCATTCCAACC (SEQ ID NO. 267) | 33352425 | 33352656 |
| DG13S1926 | TACAAGCTCCACCGTCCTTC (SEQ ID NO. 268) | TGAGTTGCTGCCTCTTCAAA (SEQ ID NO. 269) | 33388692 | 33388919 |
| DG13S1469 | TGCTAATGGGCCAAGGAATA (SEQ ID NO. 270) | GCTAAATGTCCTCATGAATAGCC (SEQ ID NO. 271) | 33416571 | 33416940 |
| DG13S351 | TGTCCTGCAGACAGATGGTC (SEQ ID NO. 272) | CCTCCGGAGTAGCTGGATTA (SEQ ID NO. 273) | 33497762 | 33498055 |
| DG13S26 | GAGACTGGCCCTCATTCTTG (SEQ ID NO. 274) | AAGAAGCCAGAGACAAAGAAATACA (SEQ ID NO. 275) | 33584096 | 33584425 |
| DG13S30 | CATCTATCTTTGGATTCAGTGGTG (SEQ ID NO. 276) | TGCTCCAACATCTTACCAG (SEQ ID NO. 277) | 33731684 | 33732071 |
| DG13S1435 | TGTCCTCTGGTCATTTCTATGGT (SEQ ID NO. 278) | CATGAATGAGAAGTGATGAATGG (SEQ ID NO. 279) | 33762069 | 33762285 |
| DG13S356 | CAGACACTGTAAACTGGCTTCG (SEQ ID NO. 280) | GCCACATTGCTATCAGCGTA (SEQ ID NO. 281) | 33908746 | 33908957 |
| DG13S2316 | ATGTGCTGTGGTCCAGATTT (SEQ ID NO. 282) | CCTACTACTGCAATTACTCCCTACC (SEQ ID NO. 283) | 33913787 | 33913954 |
| DG13S357 | TGTCATAGGCTTGCGGTATTT (SEQ ID NO. 284) | TTGGTAGGGTCCTTTCCTTT (SEQ ID NO. 285) | 33935177 | 33935378 |
| DG13S1032 | GCCTGCTCACTGTTGTTTGA (SEQ ID NO. 286) | CGGTTATCAGAGACTGGTGGT (SEQ ID NO. 287) | 33967059 | 33967269 |
| DG13S1557 | GGCTTATTTCATGTACGGCTA (SEQ ID NO. 288) | GGTTAAACTCTACTTAGTCCTGATGC (SEQ ID NO. 289) | 33996100 | 33996249 |
| DG13S1925 | GAACTCTGCAGGCACCTCTT (SEQ ID NO. 290) | CCTGAAGCGCTTGTACTGAA (SEQ ID NO. 291) | 34079148 | 34079570 |
| DG13S360 | TTGGCTTCTCGCTCTTTCTT (SEQ ID NO. 292) | AGCCATCAGTCACATGCAAA (SEQ ID NO. 293) | 34138872 | 34139221 |
| DG13S1522 | AGATCTCCAGGGCAGAGGAC (SEQ ID NO. 294) | CCTTCCTCCCTCCTTCTCTC (SEQ ID NO. 295) | 34195314 | 34195659 |
| DG13S2324 | CAGTCAAATGTCTCAACCTTCC (SEQ ID NO. 296) | CTAGCAACATGGCCAAGAAA (SEQ ID NO. 297) | 34224040 | 34224206 |

TABLE 24-continued

Basepair position of microsatellite markers (start and stop of the amplimersin NCBI sequence assembly build 34 and primer sequences (forward and reverse).

| Marker name | forward primer | reverse primer | basepair start position | basepair stop position |
|---|---|---|---|---|
| DG13S1517 | CGTCATTGATCCCAATCATCT (SEQ ID NO. 298) | GGCTGATAGCCTCCCTTGTA (SEQ ID NO. 299) | 34271358 | 34271587 |
| DG13S364 | ACCTTTCAAGCTTCCGGTTT (SEQ ID NO. 300) | TTCCATCCGTCCATCTATCC (SEQ ID NO. 301) | 34323307 | 34323478 |
| DG13S1036 | TTAAAGTCACTTGTCTGTGGTCA (SEQ ID NO. 302) | TTTGTAGGAATCAAGTCAAATAATGTA (SEQ ID NO. 303) | 34525065 | 34525280 |
| DG13S1037 | CTTTCGGAAGCTTGAGCCTA (SEQ ID NO. 304) | CCCAAGACCACTGCCATATT (SEQ ID NO. 305) | 34616658 | 34616926 |
| DG13S1854 | TGACAGGTTTGGGTATATTGGA (SEQ ID NO. 306) | TGCTTAATGTAGTGGCAGCA (SEQ ID NO. 307) | 34622055 | 34622151 |
| DG13S1038 | TCCTGCCTTTGTGAATTCCT (SEQ ID NO. 308) | GTTGAATGAGGTGGGCATTA (SEQ ID NO. 309) | 34702405 | 34702738 |
| DG13S2366 | TTGGGAATAAATCAGGTGTTGA (SEQ ID NO. 310) | GCAGCAGCTCAGCATTTCTC (SEQ ID NO. 311) | 34735455 | 34735583 |
| DG13S1039 | CCATTTAATCCTCCAGCCATT (SEQ ID NO. 312) | GCTCCACCTTGTTACCCTGA (SEQ ID NO. 313) | 34743651 | 34743817 |
| DG13S1840 | ACAACCCTGGAATCTGGACT (SEQ ID NO. 314) | GAAGGAAAGGAAAGGAAAGAAA (SEQ ID NO. 315) | 34805466 | 34805682 |
| DG13S369 | TGACAAGACTGAAACTTCATCAG (SEQ ID NO. 316) | GATGCTTGCTTTGGGAGGTA (SEQ ID NO. 317) | 34815499 | 34815755 |
| DG13S2481 | CAGGTTAGAGCCCATCCAAG (SEQ ID NO. 318) | AGGCTCAGCTTCATCCACAT (SEQ ID NO. 319) | 34867728 | 34867872 |
| D13S219 | AAGCAAATATGCAAAATTGC (SEQ ID NO. 320) | TCCTTCTGTTTCTTGACTTAACA (SEQ ID NO. 321) | 34956581 | 34956707 |
| DG13S2351 | GGGAACAGGTCACAGGTCAT (SEQ ID NO. 322) | GGAAGACTGGGTGGTCACAG (SEQ ID NO. 323) | 35099146 | 35099320 |
| DG13S384 | TTCCTTCTGCTTGTGAGCTG (SEQ ID NO. 324) | TACCCTCACCTTCCTCATGC (SEQ ID NO. 325) | 35499548 | 35499763 |
| DG13S1507 | GAAGACATTGGCAGGTCTGG (SEQ ID NO. 326) | GAGCCCTCATGTTGGGATAA (SEQ ID NO. 327) | 35557977 | 35558206 |
| DG13S1512 | TTGTTGATTCTCCCATTCTGTG (SEQ ID NO. 328) | TCACCTACCTCATCTCATACTCAA (SEQ ID NO. 329) | 35668964 | 35669201 |
| DG13S1556 | TCTTCCGGACAAGTTTCCAA (SEQ ID NO. 330) | TGGGTCATTCTGGACATTCA (SEQ ID NO. 331) | 35791215 | 35791467 |
| DG13S388 | GCAAATGAGGCTGGTAAGGT (SEQ ID NO. 332) | TGCACTGTGGTAGAGGGAAA (SEQ ID NO. 333) | 35817061 | 35817320 |
| DG13S1442 | CAACATACTCCTATGCCTAGAAAGAAA (SEQ ID NO. 334) | CTCACCAGGCAGAAACAGGT (SEQ ID NO. 335) | 35842967 | 35843335 |
| DG13S1045 | CCCAATGGCATGCTTCACT (SEQ ID NO. 336) | GGTTCTCCCAGCATTGGTT (SEQ ID NO. 337) | 35928180 | 35928324 |
| DG13S2452 | AAGGCCTCTGGGTAGGTAGG (SEQ ID NO. 338) | AAGCAATCCTTATGGGCTCT (SEQ ID NO. 339) | 35948528 | 35948826 |
| DG13S2350 | CCAGGTAATCAGAAGCCTCA (SEQ ID NO. 340) | TTCCGTTAAATCCAGCCATC (SEQ ID NO. 341) | 36011840 | 36011961 |
| DG13S2483 | CAGGGACTGCAGTGTCTCAA (SEQ ID NO. 342) | ATGCCACATTTGCCTCTCTC (SEQ ID NO. 343) | 36027396 | 36027703 |
| DG13S1100 | CCACCTTCCACTTAATACAAACTTC (SEQ ID NO. 344) | GAAGCAATCCATTCCAAGAAA (SEQ ID NO. 345) | 36056838 | 36057115 |

TABLE 24-continued

Basepair position of microsatellite markers (start and stop
of the amplimersin NCBI sequence assembly build 34 and primer
sequences (forward and reverse).

| Marker name | forward primer | reverse primer | basepair start position | basepair stop position |
|---|---|---|---|---|
| DG13S1501 | GTCCTGAGGGTGTCCAGGTA (SEQ ID NO. 346) | GCTGGAGAACTCCTATTCTGCT (SEQ ID NO. 347) | 36215761 | 36215909 |
| DG13S1868 | TGGAGCTATTGCGGTTCTCT (SEQ ID NO. 348) | TCAAATCTCTCTTTCCTCCTCCT (SEQ ID NO. 349) | 36313203 | 36313417 |
| DG13S395 | CAGTTCCAGCTACGGGAGAA (SEQ ID NO. 350) | CCGCATTTAGGCAAGTCTCA (SEQ ID NO. 351) | 36317151 | 36317507 |
| D13S1491 | AAGCACACACAGATGCTAGG (SEQ ID NO. 352) | CCTCAGCCTCCATAATCTCA (SEQ ID NO. 353) | 36361442 | 36361571 |
| DG13S400 | GTACAGAGCCCACCTTCTGG (SEQ ID NO. 354) | TCACTATGCTGCAAGGCAAG (SEQ ID NO. 355) | 36369862 | 36370134 |
| D13S894 | GGTGCTTGCTGTAAATATAATTG (SEQ ID NO. 356) | CACTACAGCAGATTGCACCA (SEQ ID NO. 357) | 36536509 | 36536706 |
| D13S218 | GATTTGAAAATGAGCAGTCC (SEQ ID NO. 358) | GTCGGGCACTACGTTTATCT (SEQ ID NO. 359) | 36830331 | 36830519 |
| DG13S1553 | TGGGTGAAGATGCTACCTGA (SEQ ID NO. 360) | CCCTTCTTCCTTTCCCTCTC (SEQ ID NO. 361) | 36898814 | 36899040 |
| DG13S411 | TGCCAGGTCTGAGTTGTAAGC (SEQ ID NO. 362) | CAGCATGAGACCCTGTCAAA (SEQ ID NO. 363) | 36908058 | 36908265 |
| DG13S1870 | GAAAGAAAGAAAGAAAGAAGAAAGAAA (SEQ ID NO. 364) | AATCACCAAACCTGGAAGCA (SEQ ID NO. 365) | 36927423 | 36927632 |
| DG13S1870 | GAAAGAAAGAAAGAAAGAAGAAAGAAA (SEQ ID NO. 366) | AATCACCAAACCTGGAAGCA (SEQ ID NO. 367) | 36927485 | 36927632 |
| DG13S39 | TCTGAGTTAAACACTTGAGTTGCTG (SEQ ID NO. 368) | CCAGTAAATGGCAGTGTGGTT (SEQ ID NO. 369) | 36957292 | 36957640 |
| DG13S2415 | TGTCATGGATATTTCTACATAAACCAA (SEQ ID NO. 370) | TGAAGATGGTTATTGCTTCCTTC (SEQ ID NO. 371) | 36984719 | 36984955 |
| DG13S412 | CGCTTTGTTTGGTTTGGTTT (SEQ ID NO. 372) | ATGCAGTTGTCCCACATGCT (SEQ ID NO. 373) | 37036929 | 37037137 |
| DG13S414 | TCCTGCACTCCAAAGGAAAC (SEQ ID NO. 374) | AACTCTGGTTTAATTCAGCTTTGTC (SEQ ID NO. 375) | 37047489 | 37047713 |
| DG13S1872 | TTCTTGAGGGCATAAAGCTGA (SEQ ID NO. 376) | CACACTCACCAGGCACTCTG (SEQ ID NO. 377) | 37119505 | 37119608 |
| DG13S416 | CAGGTTTGATGAAGGAAATATGC (SEQ ID NO. 378) | GGGATCCTCTGCATTTCTCTAA (SEQ ID NO. 379) | 37125983 | 37126184 |
| DG13S2607 | TTTGCCAAATCAACCTTCAG (SEQ ID NO. 380) | CCTGCTTCACACCTCTGACC (SEQ ID NO. 381) | 37317455 | 37317831 |
| DG13S1898 | ACTCACACACAACCACCACA (SEQ ID NO. 382) | GCTACTGGTGGGTCGTAAGC (SEQ ID NO. 383) | 37318932 | 37319055 |
| D13S1288 | TTCAGAGACCATCACGGC (SEQ ID NO. 384) | CTGGAAAAATCAGTTGAATCCTAGC (SEQ ID NO. 385) | 37321295 | 37321486 |
| DG13S2567 | AGGAAAGCCGAGAAAGCATA (SEQ ID NO. 386) | CATGTATCCACATGCCCAGA (SEQ ID NO. 387) | 37416093 | 37416462 |
| DG13S418 | CCTTCAGCGCAGCTACATCT (SEQ ID NO. 388) | AGAACTGCGAGGTCCAAGTG (SEQ ID NO. 389) | 37473016 | 37473380 |
| DG13S419 | GGGAGAAAGAGAGGTAGGAAGG (SEQ ID NO. 390) | TTCCCAAGTTAGCAGCATCC (SEQ ID NO. 391) | 37532947 | 37533123 |
| DG13S1051 | TTCTAGAGGAGTCTATTTCTTTACTGG (SEQ ID NO. 392) | GGAGCTGTCACTTGAGCTTTG (SEQ ID NO. 393) | 37694432 | 37694579 |

TABLE 24-continued

Basepair position of microsatellite markers (start and stop of the amplimers in NCBI sequence assembly build 34 and primer sequences (forward and reverse).

| Marker name | forward primer | reverse primer | basepair start position | basepair stop position |
|---|---|---|---|---|
| DG13S1841 | CCGTGACCTACAGGGAACAT (SEQ ID NO. 394) | GGCATCGGGTGTTTCTATTC (SEQ ID NO. 395) | 37715601 | 37715829 |
| DG13S1052 | AGACCTGCCTGTGTTCTGGT (SEQ ID NO. 396) | GGAGTGAAATAAGTGGAACTGGA (SEQ ID NO. 397) | 37831275 | 37831438 |
| DG13S1053 | CATTAAATGAGTCATAAAGGTCATGG (SEQ ID NO. 398) | AACATTGTTGCTTTGCTGGA (SEQ ID NO. 399) | 37935190 | 37935311 |
| DG13S423 | GGCCTTAGCTCAGTTTCTGG (SEQ ID NO. 400) | TGCAAAGACATTTGCGGATA (SEQ ID NO. 401) | 37941221 | 37941411 |
| D13S1253 | CCTGCATTTGTGTACGTGT (SEQ ID NO. 402) | CAGAGCCGTGGTAGTATATTTTT (SEQ ID NO. 403) | 37944396 | 37944533 |
| DG13S2539 | GGAACCAGTCATTTGGGTGT (SEQ ID NO. 404) | TTATTGCTCCCTCGTCCAAG (SEQ ID NO. 405) | 38050899 | 38051253 |
| DG13S2509 | TGCCTTAAGGTCTATTATTTCCTTTC (SEQ ID NO. 406) | ACCAATGCAGGAAGACTCAA (SEQ ID NO. 407) | 38067039 | 38067186 |
| DG13S1863 | CTGATGAAAGGACACACATGC (SEQ ID NO. 408) | TGCATTAACTATGCAGCTTGAAA (SEQ ID NO. 409) | 38092085 | 38092353 |
| DG13S2510 | GTCGTGCAATCCCGAGAG (SEQ ID NO. 410) | GGATTCCTGCTGGCTCTTCT (SEQ ID NO.411) | 38197807 | 38198059 |
| DG13S1909 | CTGGTGTGGTCAGGAAATGA (SEQ ID NO. 412) | GTGCTAAACACATGTGAGTGAGAG (SEQ ID NO. 413) | 38309328 | 38309442 |
| DG13S428 | TTTGACCATGCTTTCTCTTTGA (SEQ ID NO. 414) | GCTTGATGACTCCCTGCTGT (SEQ ID NO. 415) | 38346716 | 38347069 |
| DG13S1858 | AAGCCATTGAAAGGCAGGTA (SEQ ID NO. 416) | GGGACTTTCCGGCTTCTATT (SEQ ID NO. 417) | 38371574 | 38371742 |
| DG13S1911 | GGTTTGGGAACCATTCTCCT (SEQ ID NO. 418) | GCAGAGAAGGGATTTACTCCAG (SEQ ID NO. 419) | 38475656 | 38475877 |
| DG13S433 | ACTTGACATGGAGCAAGCTG (SEQ ID NO. 420) | AGCTCATCATGCTGTAAGGAG (SEQ ID NO. 421) | 38516056 | 38516191 |
| DG13S2421 | CACAGGCTCTCACATTCTCG (SEQ ID NO. 422) | TGACACTCATCCCTCTGCTG (SEQ ID NO. 423) | 38534972 | 38535357 |
| DG13S2375 | TGAGTTTCATAAGTTTACTACCTGCTG (SEQ ID NO. 424) | GGCAGGGAGAAAGGACAAAT (SEQ ID NO. 425) | 38548257 | 38548440 |
| D13S1248 | TCCCTTATGTGGGATTAGTTGA (SEQ ID NO. 426) | CAGACATGGAACTGAGATTTTTT (SEQ ID NO. 427) | 38558005 | 38558267 |
| DG13S1856 | TGTTCCATCTCTCTACCCATGT (SEQ ID NO. 428) | TCAATGTTCTTATTGAGTGGGAAA (SEQ ID NO. 429) | 38577323 | 38577506 |
| DG13S435 | ATATCCACCCACCCACACAT (SEQ ID NO. 430) | TAGCTCTGAGGGCAGAGACC (SEQ ID NO. 431) | 38591043 | 38591261 |
| DG13S2459 | CCGTCCTTCCTCCACTGAT (SEQ ID NO. 432) | AGAGCACTGAGGGAGCAAAT (SEQ ID NO. 433) | 38596056 | 38596299 |
| DG13S438 | AGCTACAGCACGAGGCAGTT (SEQ ID NO. 434) | TTTGAATTGAGTTGCTGTTCG (SEQ ID NO. 435) | 38676957 | 38677248 |
| DG13S1865 | TGTACACCACCAACCATTCTG (SEQ ID NO. 436) | GGGAAGAAAGGCAAATAGCA (SEQ ID NO. 437) | 38684800 | 38684904 |
| DG13S2354 | GGATTGGCAATTAGCAGGTC (SEQ ID NO. 438) | GCCTGGTCAAAGATAACAGACG (SEQ ID NO. 439) | 38773862 | 38774026 |
| DG13S2534 | CCTGATTAAGCTGGCCTTTG (SEQ ID NO. 440) | ATCCTTCTGGGACCCTCATC (SEQ ID NO. 441) | 38801698 | 38801951 |

TABLE 24-continued

Basepair position of microsatellite markers (start and stop of the amplimersin NCBI sequence assembly build 34 and primer sequences (forward and reverse).

| Marker name | forward primer | reverse primer | basepair start position | basepair stop position |
|---|---|---|---|---|
| DG13S1903 | GCTTTGCTTCCTTCTTGGTG (SEQ ID NO. 442) | CAACATTACGGCCAGTCTCA (SEQ ID NO. 443) | 38802843 | 38803052 |
| DG13S1896 | GGTGCATCTGATAAGCCAAA (SEQ ID NO. 444) | GCTGTCTTGGACACAGTGGA (SEQ ID NO. 445) | 38815291 | 38815405 |
| DG13S443 | CACCATCATCATCTGGTTGG (SEQ ID NO. 446) | GAGCTCATTGAAAGGCAGGA (SEQ ID NO. 447) | 38838883 | 38839093 |
| DG13S445 | CCATCCATCTATCCATTTATCTCTG (SEQ ID NO. 448) | GGATTTATCCTTGCCCTGCT (SEQ ID NO. 449) | 38840399 | 38840584 |
| DG13S447 | CTATCATCCATCCATCCTATTTG (SEQ ID NO. 450) | TTAGGGCAGCTACCTGGAAA (SEQ ID NO. 451) | 38840751 | 38840928 |
| D13S1233 | AGGACTANAGATGAATGCTC (SEQ ID NO. 452) | GACATGACTCCATGTTTGGT (SEQ ID NO. 453) | 38875108 | 38875292 |
| DG13S2320 | CCTCACCTTGCAATTTCCTG (SEQ ID NO. 454) | CTGACTTGCCTGTTGGCATA (SEQ ID NO. 455) | 38957405 | 38957570 |
| DG13S451 | TTTGGGATCTTGAAGACCTTT (SEQ ID NO. 456) | TTGTGGCATGTCCTTGGTT (SEQ ID NO. 457) | 39032835 | 39033191 |
| DG13S180 | TGTACACTGCAAACATTGCTAAA (SEQ ID NO. 458) | TTGTCCTTTCATTATGACGTGTCT (SEQ ID NO. 459) | 39233968 | 39234350 |
| DG13S458 | AAGCCTGAAAGGATACACACAAA (SEQ ID NO. 460) | CAGGATCCCAGACTTTCCAG (SEQ ID NO. 461) | 39475899 | 39476187 |
| DG13S2547 | GGTGAATCCCACCCTCATAC (SEQ ID NO. 462) | TTGGTATGTTTCCTATTGTTGCAT (SEQ ID NO. 463) | 39612492 | 39612849 |
| D13S244 | GAACCAGTGAGTTTTTATTAC (SEQ ID NO. 464) | AGACACAGCATATAATACATG (SEQ ID NO. 465) | 39665226 | 39665353 |
| DG13S2435 | TGAAGCTTTGTGGCTTGTTG (SEQ ID NO. 466) | GACTGAGTCCACAGCCCATT (SEQ ID NO. 467) | 39863067 | 39863301 |
| D13S263 | CCTGGCCTGTTAGTTTTTATTGTTA (SEQ ID NO. 468) | CCCAGTCTTGGGTATGTTTTTA (SEQ ID NO. 469) | 39878976 | 39879126 |
| DG13S188 | CCACCATGCAAGAACAGATG (SEQ ID NO. 470) | GCTTTGCACTTGGCTGTCTT (SEQ ID NO. 471) | 39935769 | 39936103 |
| DG13S189 | TTGCATGAAGTAAAGTATCCCTGT (SEQ ID NO. 472) | CACAAACCACAAGATGATTGG (SEQ ID NO. 473) | 39968676 | 39969030 |
| DG13S190 | GGGCATCATGTCTACAACTCA (SEQ ID NO. 474) | ACCAAGGGCACTTGCTGATA (SEQ ID NO. 475) | 40027542 | 40027801 |
| DG13S2370 | AGGATGAAGAGGGAGGAAGG (SEQ ID NO. 476) | CCAGACTGATCTTCCTTAATTAGTTG (SEQ ID NO. 477) | 40159684 | 40159812 |
| DG13S196 | CCTCCTCTTTCTGCTGCTGT (SEQ ID NO. 478) | AGCCAAAGAACCCAAAGAAAC (SEQ ID NO. 479) | 40251445 | 40251793 |
| DG13S2457 | GCCCTACTTTGCCTCAGAAA (SEQ ID NO. 480) | GCAACTCATGCCAGCCTCTA (SEQ ID NO. 481) | 40376042 | 40376447 |
| DG13S2445 | AACTGTGTTAATGATGGGCAAA (SEQ ID NO. 482) | AACGAGCGCATGAAACCTAT (SEQ ID NO. 483) | 40422793 | 40423200 |
| DG13S211 | CCTGGTCAATTGAACCCAAA (SEQ ID NO. 484) | TGAAGGAAGATAAAGCAGGGTAA (SEQ ID NO. 485) | 40434073 | 40434172 |
| DG13S472 | CTCTCTCTGGCCCTCTCTTG (SEQ ID NO. 486) | GGTAACTTGCCATTCTTCTACCA (SEQ ID NO. 487) | 40476985 | 40477395 |
| DG13S207 | ACTCCACCTGAAGGGAGAAA (SEQ ID NO. 488) | TGGAAGCCACTAATTGGAGAA (SEQ ID NO. 489) | 40545942 | 40546202 |

TABLE 24-continued

Basepair position of microsatellite markers (start and stop of the amplimersin NCBI sequence assembly build 34 and primer sequences (forward and reverse).

| Marker name | forward primer | reverse primer | basepair start position | basepair stop position |
|---|---|---|---|---|
| DG13S200 | AATGGATGGATACCTCCTTATCA (SEQ ID NO. 490) | CTCATTGTGGCTTTCTGTGC (SEQ ID NO. 491) | 40737337 | 40737570 |
| DG13S198 | GTACCCACACCTCACCAAGC (SEQ ID NO. 492) | CGTAGCTCACATTCCCAACA (SEQ ID NO. 493) | 40811813 | 40812059 |
| DG13S215 | GGCGAGTGAAAGAGAGGACA (SEQ ID NO. 494) | GGGTGGTAATTCCCAGATGA (SEQ ID NO. 495) | 40871695 | 40871992 |
| DG13S221 | TCTGCAACAGCCAGAATCAA (SEQ ID NO. 496) | TGTCTGTTGGCAACTTTCTGTC (SEQ ID NO. 497) | 41107773 | 41108117 |
| DG13S219 | AGGTGAACCCAGTCCAGCTA (SEQ ID NO. 498) | TCTTAGGCAAAGGAGCCAGT (SEQ ID NO. 499) | 41127591 | 41127734 |
| D13S1270 | ACATGAGCACTGGTGACTG (SEQ ID NO. 500) | GGCCTCAAATGTTTTAAGCA (SEQ ID NO. 501) | 41161654 | 41161831 |
| DG13S225 | TTCTGGGTGTTCGCTATTCC (SEQ ID NO. 502) | TTTCCTGTCCAGTCCTGACC (SEQ ID NO. 503) | 41212951 | 41213310 |
| D13S1276 | GTTTTGCAGGTCTAGGTCACAC (SEQ ID NO. 504) | AGGATAGCTTGAGCCCG (SEQ ID NO. 505) | 41213917 | 41214090 |

All references cited herein are incorporated by reference in their entirety. While this invention has been particularly shown and described with references to preferred embodiments thereof, it will be understood by those skilled in the art that various changes in form and details may be made therein without departing from the scope of the invention encompassed by the appended claims.

EXAMPLE 10

Randomized, Placebo-Controlled, Crossover Clinical Trial Demonstrates Inhibition of FLAP Reduced Biomarkers of Risk of Myocardial Infarction The 5-lipoxygenase pathway, through FLAP, leads to the production of leukotriene $B_4$, one of the most potent chemokine mediators of arterial inflammation. The experiments described in Example 7 showed that MI patients make more $LTB_4$ than do controls. Hence, it appears that the at-risk variant upregulates the leukotriene pathway. A clinical trial was carried out to demonstrate that patients with the genetic variation in FLAP that predisposes to MI could benefit from inhibiting FLAP, with the FLAP inhibitor DG-031. In the short term study, changes in levels of biomarkers that are associated with risk of MI were scored as evidence of changes in the risk of MI.

Patient Population

All patients in the study had a history of MI and were carriers of specific MI-associated haplotypes in the FLAP and/or the $LTA_4$ hydrolase genes (See U.S. patent application Ser. No. 10/944,272 (now abandoned; published as U.S. 2005/0272051A1) and PCT Application No. PCT/2004/030582, incorporated by reference in its entirety. The recruitment process included individuals who had previously participated in a study of the genetics of MI (Helgadottir et al., Nat. Genet. 2004;36(3):233-9. 2004). Apart from FLAP, the $LTA_4$, hydrolase gene also shows significant association to MI in Iceland and baseline mRNA expression of the $LTA_4$ hydrolase gene is greater in MI patients than in control subjects; that is subjects with at-risk variants in either the FLAP or $LTA_4$ hydrolase genes are at increased risk of sustaining MI. Thus, carriers of either the FLAP or $LTA_4$ hydrolase at-risk haplotypes were recruited and their haplotypes were confirmed by analysis of DNA from blood sample collected in the study.

Nine Single Nucleotide Polymorphism (SNP) markers were genotyped to define the at-risk haplotypes. These SP markers are set out in Table 25 below and are described in detail in Example 1. SNPs genotyping within the FLAP and $LTA_4$ hydrolase genes was performed using SNP-based Taqman platform (ABI) as described in Helgadottir et al., 2004 March;36(3):233-9. The haplotypes carried by each individual were estimated using the program NEMO (version 1.01) and 902 in-house population controls, as described in Gretarsdottir et al., Nat Genet 35:131-8, 2003.

TABLE 25

Genotypes used to derive FLAP and $LTA_4$ hydrolase at-risk haplotypes.

| | Haplotype | Allele | SNP | Allele | SNP | Allele | SNP |
|---|---|---|---|---|---|---|---|
| 1 | A3 (FLAP gene) | G | SG13S25 | T | SG13S114 | A | SG13S32 |
| 2 | AF (FLAP gene) | G | SG13S25 | T | SG13S114 | | |
| 3 | NA3 (FLAP gene) | A | SG13S122 | C | SG13S32 | C | SG13S8 |
| 4 | HF ($LTA_4$-OH gene) | A | SG12S25 | C | SG12S223 | | |
| 5 | GF ($LTA_4$-OH gene) | A | SG12S225 | T | SG12S233 | | |

The recruits were asked for permission for the use of their medical and genetic information already collected at deCODE genetics (Reykjavik, Iceland) for the clinical trial. Of over 900 patients identified as eligible by clinical and genotypic criteria, 640 returned their signed consent providing permission to use their genetic and medical data. The genotypes for the FLAP and $LTA_4$ hydrolase genes were subsequently reconfirmed, and those who were carriers of variants in the FLAP and/or $LTA_4$ hydrolase genes were judged eligible for the study if they also met the other inclusion criteria and none of the exclusion criteria set out in Table 26. The baseline characteristics of the patients participating in the study are set out in Table 27. All patients who participated gave informed consent and the protocol was approved by the National Bioethics Committee in Iceland.

TABLE 26

Study eligibility criteria.

Inclusion criteria

Age 40 to 75.
Carrier of the FLAP and/or the $LTA_4$ hydrolase haplotype
Documented CAD with previous history of MI
Women of childbearing potential must have a negative urine pregnancy test at visit 1 and are required to use 2 adequate barrier methods of contraception throughout the study.
Understanding of the study procedures and agreement to participate in the study by giving written informed consent.

TABLE 26-continued

Study eligibility criteria.

Exclusion criteria

Confirmed diagnosis of congestive heart failure (CHF).
Any experimental treatment within 2 months of screening or planned for the following 3 months.
Acute CV event (such as ACS, MI or stroke) within 1 month prior to enrolment.
Elevated CPK above 3 fold upper normal limit (UNL). Other liver function tests and kidney function tests above 1.5 fold upper normal limit.
Immunocompromised subjects, including subjects known to be HIV positive or with malignant disease and/or on chronic immunosuppressive therapy.
Subjects known to have positive serology results for HBsAg, HCV Ab.
Treatment with immunosuppressive cytotoxic drugs or corticosteroids within 6 weeks or during conduct of study.
Major surgery within 6 weeks prior to enrolment.
Any other major intercurrent illness and other condition, which, in the investigator's judgement, will interfere with the subject's participation in this study.
Subjects not willing to return for follow-up or with known history of non-compliance.
Patients who consume more than 2 alcoholic drinks/day or $\geqq 10$ drinks/week, or history of alcohol abuse within the past 2 years.
Patients must agree to comply with the restrictions on alcohol ($\leqq 2$ drinks/day and <10 drinks/week and no alcohol intake within 48 hours of study visits).
Pregnant or lactating women.
Poor mental function or any other reason to expect patient difficulty in complying with the requirements of the study.

TABLE 27

Baseline Characteristics of the Study Cohort

| Characteristic | 250 mg/day | | 500 mg/day | | 750 mg/day | |
|---|---|---|---|---|---|---|
| | Active-placebo (n = 32) | Placebo-active (n = 32) | Active-placebo (n = 32) | Placebo-active (n = 32) | Active-placebo (n = 32) | Placebo-active (n = 31) |
| Demography | | | | | | |
| Male/Female | 24/8 | 24/8 | 24/8 | 24/8 | 24/8 | 24/7 |
| Age (SD), years | 66 (8) | 66 (8) | 65 (7) | 67 (7) | 64 (8) | 67 (7) |
| Age range, years | 47-75 | 47-75 | 51-75 | 52-75 | 47-75 | 56-75 |
| Age > 60 years, % | 78% | 75% | 78% | 78% | 69% | 74% |
| Weight (SD), kg | 86 (11) | 87 (12) | 86 (14) | 92 (18) | 91 (13) | 93 (19) |
| Height (SD), cm | 173 (8) | 174 (7) | 173 (8) | 174 (9) | 174 (7) | 173 (10) |
| BMI (SD), kg/m$^2$ | 29 (3) | 29 (3) | 29 (4) | 30 (6) | 30 (4) | 31 (5) |
| Cardiovascular history | | | | | | |
| Two or more prev. infarcts | 3 (9%) | 6 (19%) | 3 (9%) | 7 (22%) | 6 (19%) | 8 (26%) |
| Time since last MI (mo's) | 146 (63) | 137 (73) | 143 (65) | 121 (68) | 129 (71) | 131 (59) |
| Hypertension (current) | 5 (16%) | 10 (31%) | 4 (12%) | 4 (12%) | 8 (25%) | 7 (23%) |
| Diabetes | 10 (31%) | 8 (25%) | 6 (19%) | 12 (38%) | 8 (25%) | 10 (32%) |
| Haplotype frequency | | | | | | |
| A3 carrier (FLAP) | 8 (25%) | 7 (22%) | 8 (25%) | 5 (16%) | 11 (34%) | 13 (42%) |
| AF carrier (FLAP)* | 29 (91%) | 27 (84%) | 28 (88%) | 28 (88%) | 28 (88%) | 26 (84%) |
| NA3 carrier (FLAP) | 5 (16%) | 5 (16%) | 4 (12%) | 3 (9%) | 3 (9%) | 0 (0%) |
| HF carrier ($LTA_4$-OH) | 13 (41%) | 18 (56%) | 19 (59%) | 22 (69%) | 13 (41%) | 20 (65%) |
| GF carrier ($LTA_4$-OH) | 3 (9%) | 9 (28%) | 5 (16%) | 6 (19%) | 7 (22%) | 3 (10%) |
| NA3/A3 & HF/GF carrier | 11 (34%) | 12 (38%) | 9 (28%) | 15 (47%) | 9 (28%) | 14 (45%) |
| Relevant medication | | | | | | |
| Statins (%) | 27 (84%) | 28 (88%) | 26 (81%) | 28 (88%) | 25 (78%) | 27 (87%) |
| Other chol'l low'ng drug (%) | 0 (0%) | 0 (0%) | 3 (9%) | 1 (3%) | 1 (3%) | 1 (3%) |
| Aspirin (%) | 28 (88%) | 28 (88%) | 28 (88%) | 25 (78%) | 27 (84%) | 26 (84%) |
| Nitrates (%) | 13 (41%) | 12 (38%) | 10 (31%) | 8 (25%) | 8 (25%) | 12 (39%) |
| Ca-channel blockers (%) | 9 (28%) | 6 (19%) | 9 (28%) | 7 (22%) | 7 (22%) | 8 (26%) |
| ACE-inhibitors (%) | 7 (22%) | 10 (31%) | 12 (38%) | 10 (31%) | 10 (31%) | 13 (42%) |
| Beta-blockers (%) | 22 (69%) | 23 (72%) | 23 (72%) | 18 (56%) | 24 (75%) | 22 (71%) |
| Diuretics (%) | 9 (28%) | 13 (41%) | 7 (22%) | 7 (22%) | 11 (34%) | 9 (29%) |

TABLE 27-continued

Baseline Characteristics of the Study Cohort

| | 250 mg/day | | 500 mg/day | | 750 mg/day | |
| --- | --- | --- | --- | --- | --- | --- |
| Characteristic | Active-placebo (n = 32) | Placebo-active (n = 32) | Active-placebo (n = 32) | Placebo-active (n = 32) | Active-placebo (n = 32) | Placebo-active (n = 31) |
| Plasma lipids | | | | | | |
| Cholesterol (SD), mmol/L | 5.0 (1.0) | 5.0 (0.8) | 5.2 (1.0) | 4.8 (1.1) | 5.2 (1.2) | 5.0 (1.0) |
| HDL (SD), mmol/L | 1.4 (0.3) | 1.4 (0.3) | 1.5 (0.3) | 1.4 (0.5) | 1.4 (0.4) | 1.4 (0.3) |
| LDL (SD), mmol/L | 3.0 (1.0) | 3.0 (0.7) | 3.1 (1.0) | 2.9 (1.0) | 3.2 (1.0) | 3.0 (0.9) |
| Triglycerides (SD), mmol/L | 1.4 (0.8) | 1.5 (0.7) | 1.7 (1.6) | 1.3 (0.7) | 1.4 (0.7) | 1.4 (0.6) |
| Blood pressure | | | | | | |
| Diastolic (SD), mmHg | 79 (8) | 78 (7) | 81 (11) | 79 (9) | 78 (12) | 78 (7) |
| Systolic (SD), mmHg | 137 (13) | 133 (19) | 139 (22) | 136 (17) | 141 (22) | 140 (17) |
| Smoking habits | | | | | | |
| Never smoked | 9 (28%) | 4 (13%) | 5 (16%) | 3 (9%) | 8 (25%) | 7 (23%) |
| Prior history of smoking | 18 (56%) | 20 (63%) | 19 (59%) | 24 (75%) | 19 (59%) | 16 (52%) |
| Current smoker | 5 (16%) | 8 (25%) | 8 (25%) | 5 (16%) | 5 (16%) | 8 (26%) |
| Alcohol use | | | | | | |
| Never used alcohol | 4 (13%) | 4 (13%) | 2 (6%) | 5 (16%) | 5 (16%) | 5 (16%) |
| Prior use of alcohol | 1 (3%) | 5 (16%) | 4 (13%) | 3 (9%) | 4 (13%) | 2 (6%) |
| Current use of alcohol | 27 (84%) | 23 (72%) | 26 (81%) | 24 (75%) | 23 (72%) | 24 (77%) |

*a common low-risk haplotype (RR 1.3) carried by 85-90% of study subjects

Study Conduct

All study participants lived in the Reykjavik metropolitan area or its neighboring townships. All study participants were followed by the designated cardiologists at the University Hospital of Iceland, at their outpatient or private clinics, and all subjects had participated in a study on the genetics of MI. After the subject had given informed consent, a medical and medication history was completed, including co-morbidities, concomitant medications and specific details about the subject's cardiovascular history, including current status. All study participants were fasting and had not taken their medications prior to the study visit. Cardiologists examined the patients at all 8 visits and completed the case report forms. All blood was collected and processed immediately after sampling. All blood specimens used for the biomarker studies were processed within 2 hours of blood sampling.

Study Drug

Figure 7:
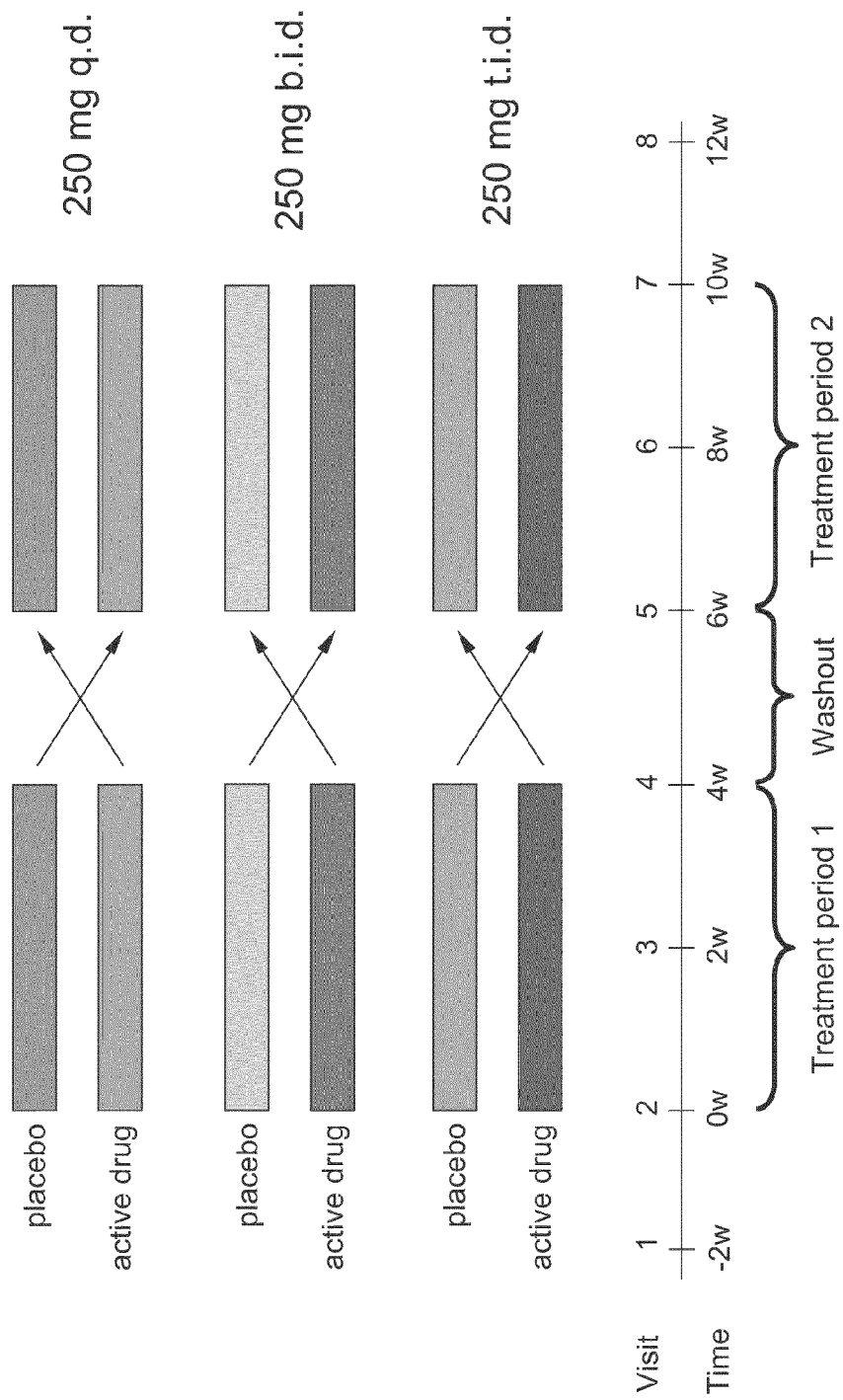
FIG. 7 provides a schematic of the clinical trial schedule. This figure shows that at Visit 2 (on Day 1 of study) subjects were randomised into each of the three arms and to either placebo or active drug within each arm. A 2-week washout period separated the 4-week treatment periods. Cross-over was performed at week 6.
Figure 8:
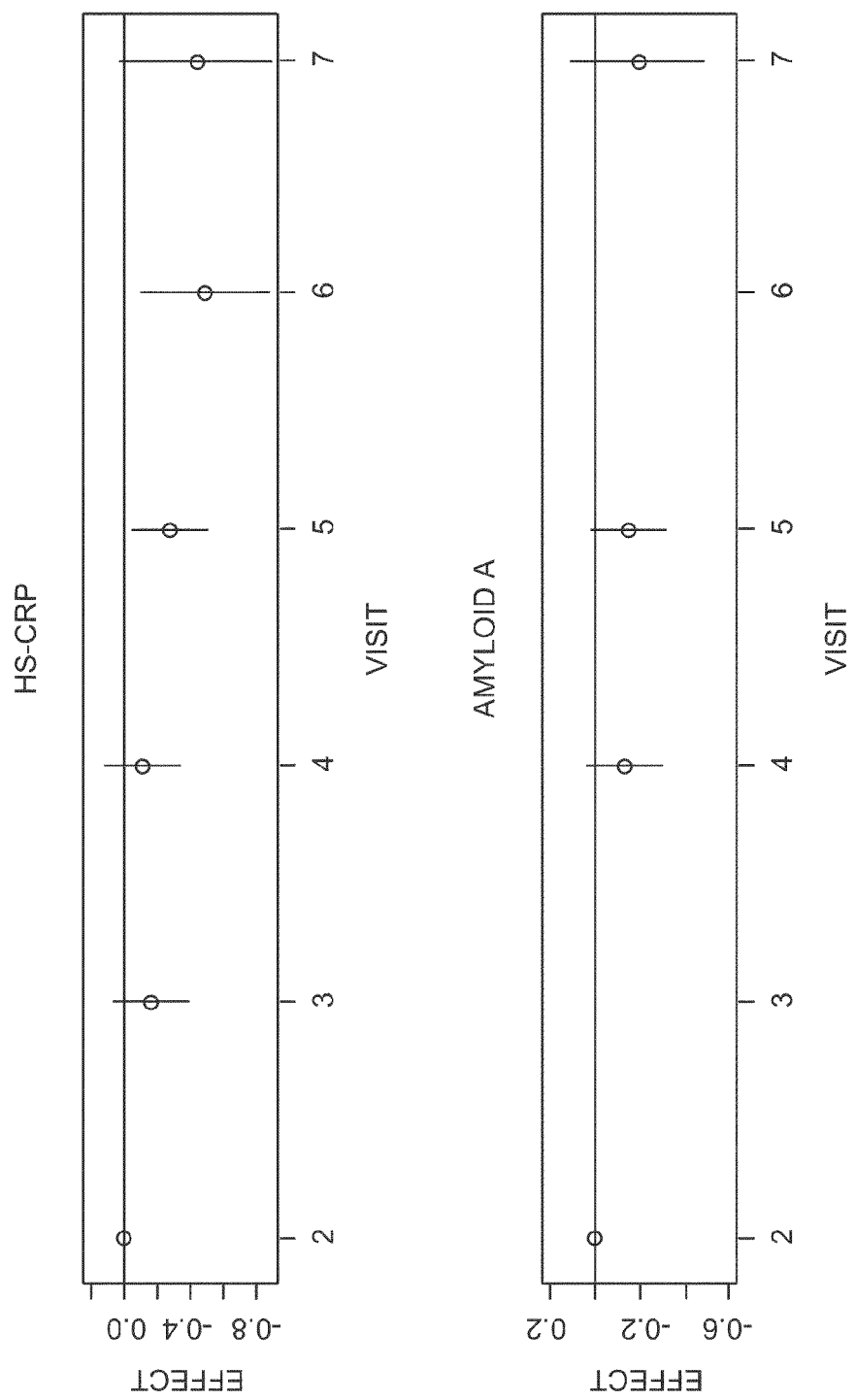
FIG. 8 shows the analysis of carry-over effect for CRP and SAA (on log-scale).

Patients (191 subjects) who met the study eligibility criteria were enrolled and randomized into 3 different dose-level groups: (1) 64 patients on 250 mg/day therapy with DG-031 (250 mg q.d.), vs placebo; (2) 64 patients on 500 mg/day therapy with DG-031 (250 mg b.i.d.) vs placebo; and (3) 63 patients on 750 mg/day therapy with DG-031 (250 mg t.i.d.) vs placebo. The 750 mg/day dose was well tolerated in previous phase I-III human studies (Dahlen et al., Thorax 1997; 52:342-7; Hamilton et al., Thorax 1997; 52:348-54), conducted on healthy volunteers and patients with asthma as a part of the drug development program for Bayer x 1005 (now DG-031). All patients received 3 tablets per day. Treatment periods, 4 weeks in duration each, were separated by a 2-week washout period. The placebo tablets were identical in shape, color, form and taste to the active tablets except that they contained no active drug ingredients. Treatment with DG-031 or placebo was in addition to the subject's standard care, including all medications and treatment plan as prescribed by the subject's cardiologist prior to enrollment. The cross-over study design is summarized in FIG. 7. Due to early termination of 19 subjects (primarily related to unavailability due to travel), 11 were replaced prior to enrollment closure. Thus, a total of 191 subjects were enrolled, with 172 completing all 8 visits or 8 patients (4.4%) short of target. Three subjects did not return for early termination visit.

Data Analysis, Randomization and Statistical Considerations

All data were analyzed according to a pre-established analysis plan and by intention-to-treat. Hypotheses were tested at a two-sided nominal significance level of 0.05. Each arm of the study, as well as pooled sets (combining dose levels), was considered for the primary analysis. Each such set is a standard AB/BA cross-over design and in the primary analysis of efficacy, the levels of biomarkers of MI risk at the end of the treatment periods (visits 4 and 7) were used as primary response variables. The difference between DG-031 and placebo treatment was the primary outcome, assessed separately for each of the biomarkers. Treatment effect was tested using a two-sample t-test on the period differences for suitably transformed response variables, under an assumption of normality of the transformed data. We report treatment effect as one half of the observed mean differences in the two-sample t-test, with a 95% CI. No pre-tests for carry-over effect were performed as a part of the primary analysis. Tests for carry-over were done and are reported separately from results of primary analysis. As was prespecified for the primary analysis, a simple Bonferroni-adjustment based on 10 biomarkers for the primary objective for the pooled set of the two highest doses, was used to report the outcome of the primary objective. All p-values reported are nominal.

To cancel out potential seasonal effects, carry-over effects were also studied with two-sample t-tests that compare measurements of the AB (drug/placebo) group with the measurements of the BA (placebo/drug) group. To estimate the effect of the drug at visit 3 for the AB group, (v3−v2), with v3 and v2 denoting, respectively, measurements at visit 3 and visit 2, was used. Similarly (v4–v2) and (v5–v2) were used to estimate effects at visits 4 and 5. For estimating the effect at visit 6, [(v6–v2)+(v3–v2)] was used. Note that v6 from the BA group includes the drug effect after two weeks which cancels the drug effect at visit 3 from the AB group. Similarly, [(v7–v2)+(v4–v2)] was used to estimate the effect at visit 7. The two higher dose AB groups were used for all visits. All 3 BA groups are used for visits 3, 4 and 5 since they had all received the same treatment until visit 5, but only the two higher dose BA groups are used for visits 6 and 7.

The sample size for this study was chosen so that each of the three arms provided, after up to 5% dropout, at least 80% power (with $\alpha=0.05$, two-sided) to detect a relative lowering of 15% for a log-normal response variable, given that an assay for that variable has a coefficient of variation of 20% and the intra-person coefficient of variation is as high as 25%. Based on these assumptions, the recruitment target included 180 subjects with randomization into 3 different dose-level groups as described above.

At the enrollment visit, an independent study nurse who was blinded to the drug content, dispensed medication kits according to a computer generated randomization list. Randomization of study patients was stratified according to sex. For both strata, a permuted block design with block size 12 was used to assign patients into each of the six sequences of the study. All biomarkers were transformed using a shifted log transform (transformed value is natural log of original value plus a shifting constant for each assay). Missing data were filled in using a simple last observation carried forward (LOCF) scheme, in cases where no previous measurement existed, next observation was carried back. Statistical outliers for data sets were brought in based on IQR distance from median.

Biomarker Measurements

The ELISA and mass spectrometry assays were used to measure the levels of the MI at risk biomarkers and are summarized in Table 28. Apart from measurements in plasma, $LTB_4$ and MPO were also measured in whole blood preparations ex vivo following ionomycin-activation of leukocytes, using ELISA and mass spectrometry. Both dose- and time-dependent stimulations were performed to determine the maximum $LTB_4$ and MPO output of the cells. Correction was made for white blood cell count, as the amount of these mediators produced relates to the number of cells in a fixed volume. On the log scale the adjustment was based on a linear model, with coefficients determined empirically at time of blind review. Several tertiary markers were also measured including: IL-6, IL-12p40, TNFα, MMP-9, sICAM, sVCAM, P-selectin, E-selectin, MCP-1 and oxidised LDL.

TABLE 28

Methods and assays used to quantify study biomarkers

| Assay | Supplier | Name of kit | Catalog nr. | Principle of the method | Ref |
|---|---|---|---|---|---|
| ELISA method | | | | | |
| Myeloperoxidase (MPO) | Assay Design, Inc. | Titerzyme EIA | # 900-115 | A quantitative solid phase sandwich ELISA | 14 |
| $LTB_4$ | R&D | $LTB_4$ | # DE0275 | A competitive binding immunoassay | 15 |
| Amyloid A | Biosource | Human SAA kit | # KHA0012 | A quantitative solid phase sandwich ELISA | 16 |
| Cysteinyl Leukotriene | R&D | Cysteinyl Leukotriene | # DE3200 | A competitive binding immunoassay | 17 |
| Nitrotyrosine | OxisResearch | Bioxytech Nitro tyrosine-EIA | # 21055 | A quantitative solid phase sandwich ELISA | 18 |
| TNF-α | R&D | Quantikine HS Human TNF-α | # HSTA00C | A quantitative solid phase sandwich ELISA | 19 |
| IL6 | R&D | Quantikine HS Human IL-6 | # HS600B | A quantitative solid phase sandwich ELISA | 20 |
| IL12p40 | R&D | Quantikine Human IL-12p40 | # DP400 | A quantitative solid phase sandwich ELISA | 21 |
| MCP-1 | R&D | Quantikine Human MCP-1 | # DCP00 | A quantitative solid phase sandwich ELISA | 22 |
| ICAM | R&D | Parameter human sICAM-1 | # BBE 1B | A quantitative solid phase sandwich ELISA | 23 |
| sE-Selectin | R&D | Parameter human sEselectin | # BBE 2B | A quantitative solid phase sandwich ELISA | 24 |
| sP-Selectin | R&D | Parameter human sPselectin | # BBE 6 | A quantitative solid phase sandwich ELISA | 25 |
| VCAM | R&D | Parameter human sVCAM-1 | # BBE 3 | A quantitative solid phase sandwich ELISA | 26 |
| MMP 9 | R&D | Quantikine Human MMP-9(total) | # DMP900 | A quantitative solid phase sandwich ELISA | 27 |
| Oxidised LDL | Mercodia | Oxidised LDL Elisa | # 10-1143-01 | A quantitative solid phase sandwich ELISA | 28 |
| $Lp-PLA_2$ | Diadexus San Fransisco, CA | PLAC test | | A quantitative solid phase sandwich ELISA | 29 |
| Other methods | | | | | |
| Hs-CRP | Roche Hitachi 912 analyser | Hs-CRP | 11972855 | Immunoturbidimetric assay | 30 |
| $LTB_4$ (MS) | LC/MS/MS | $LTB_4$ assay | | Mass spectrometer with internal standard | 31 |

Clinical Outcome

Baseline values for the biomarker variables prior to treatment are shown in Table 29. For the primary efficacy endpoint, as specified in the statistical analysis plan, 10 variables were considered in the pooled set of subjects on 500 mg and 750 mg arms and the data is set out in Table 30. The primary efficacy endpoint of the study was confirmed by showing that DG-031 reduces levels of $LTB_4$ produced by ionomycin-activated neutrophils ex vivo for the pooled set of 500 mg and 750 mg arms (nominal p=0.0042), and this is statistically significant after correction for multiple testing. As shown in Table 30, the maximum reduction in $LTB_4$ and MPO production amounted to 26% for $LTB_4$ (nominal p=0.0026) and 13% for MPO (nominal p=0.023) at the 750 mg/day dose of DG-031. DG-031 also reduced significantly serum sICAM-1 (nominal p=0.02), but no effects were observed on other tertiary markers. $Lp\text{-}PLA_2$ increased by 9% (nominal p=0.0056) in response to the highest dose of DG-031 and there was comparable increase observed in LDL cholesterol (8%) that correlated with $Lp\text{-}PLA_2$. In contrast, the effects of the 2 lower doses (250 mg/day and 500 mg/day) on $Lp\text{-}PLA_2$ were not significant. Urine levels of $LTE_4$ increased by 27% in response to the highest dosage of DG-031 (nominal p=0.00002)). Significant correlation was observed between the inhibition of $LTB_4$ and MPO production in response to DG-031 (r=0.65, p<0.00001).

TABLE 29

Summary statistics of baseline biomarker values.

| | 250 mg/day | | 500 mg/day | | 750 mg/day | |
|---|---|---|---|---|---|---|
| Assay | Active-placebo (n = 32) | Placebo-active (n = 32) | Active-placebo (n = 32) | Placebo-active (n = 32) | Active-placebo (n = 32) | Placebo-active (n = 31) |
| *Primary objectives* | | | | | | |
| Amyloid A | 9.92 (0.94) n = 32 | 9.84 (0.75) n = 32 | 9.78 (0.91) n = 32 | 9.44 (0.43) n = 32 | 9.74 (0.43) n = 32 | 9.63 (0.50) n = 31 |
| Hs-CRP | 0.78 (0.88) n = 32 | 0.95 (1.12) n = 32 | 0.75 (1.19) n = 32 | 0.46 (0.73) n = 32 | 0.89 (0.81) n = 32 | 0.77 (0.86) n = 31 |
| $Lp\text{-}PLA_2$ | 5.47 (0.33) n = 32 | 5.50 (0.29) n = 32 | 5.49 (0.27) n = 32 | 5.32 (0.39) n = 32 | 5.51 (0.41) n = 32 | 5.42 (0.22) n = 31 |
| $LTB_4$ in whole blood[†] | 10.78 (0.85) n = 32 | 11.02 (0.85) n = 32 | 10.41 (0.65) n = 32 | 10.54 (0.75) n = 31 | 10.74 (0.57) n = 32 | 10.85 (0.87) n = 30 |
| $LTB_4$ in w. b.[*], corr for wbc[†,‡] | 8.14 (0.71) n = 32 | 8.24 (0.76) n = 32 | 7.79 (0.68) n = 32 | 7.95 (0.69) n = 31 | 8.11 (0.59) n = 32 | 8.11 (0.72) n = 30 |
| $LTE_4$ in urine | 6.57 (0.33) n = 31 | 6.69 (0.32) n = 31 | 6.53 (0.40) n = 32 | 6.55 (0.38) n = 32 | 6.67 (0.48) n = 32 | 6.69 (0.40) n = 31 |
| MPO in plasma | 3.72 (0.51) n = 32 | 3.71 (0.55) n = 32 | 3.47 (0.41) n = 32 | 3.51 (0.37) n = 32 | 3.71 (0.45) n = 31 | 3.72 (0.52) n = 31 |
| MPO in whole blood | 6.54 (0.49) n = 31 | 6.67 (0.37) n = 32 | 6.47 (0.44) n = 32 | 6.38 (0.49) n = 31 | 6.56 (0.34) n = 32 | 6.64 (0.47) n = 31 |
| MPO in w. b.[*], corr. for wbc[‡] | 4.69 (0.39) n = 31 | 4.74 (0.37) n = 32 | 4.65 (0.37) n = 32 | 4.58 (0.44) n = 31 | 4.73 (0.33) n = 32 | 4.75 (0.34) n = 31 |
| N-tyrosine | 3.18 (0.73) n = 31 | 3.40 (1.02) n = 31 | 3.25 (0.95) n = 28 | 3.81 (1.48) n = 29 | 3.50 (0.99) n = 31 | 3.66 (1.42) n = 30 |
| *Tertiary objectives* | | | | | | |
| ICAM | 5.67 (0.27) n = 32 | 5.67 (0.21) n = 32 | 5.65 (0.29) n = 32 | 5.66 (0.20) n = 32 | 5.69 (0.25) n = 32 | 5.68 (0.23) n = 31 |
| IL12p40 | 4.98 (0.41) n = 32 | 4.87 (0.48) n = 32 | 4.86 (0.36) n = 32 | 5.04 (0.42) n = 32 | 5.02 (0.50) n = 32 | 4.96 (0.43) n = 31 |
| IL6 | 0.87 (0.40) n = 32 | 1.15 (0.63) n = 32 | 1.07 (0.89) n = 32 | 0.90 (0.32) n = 32 | 0.95 (0.71) n = 32 | 1.11 (0.42) n = 31 |
| MCP-1 | 5.92 (0.39) n = 32 | 5.90 (0.23) n = 32 | 5.86 (0.21) n = 32 | 5.94 (0.24) n = 31 | 5.92 (0.23) n = 32 | 5.91 (0.23) n = 31 |
| MMP 9 | 6.34 (0.39) n = 32 | 6.40 (0.44) n = 32 | 6.10 (0.47) n = 32 | 6.20 (0.42) n = 32 | 6.15 (0.43) n = 32 | 6.15 (0.52) n = 31 |
| Oxidized - LDL | 11.09 (0.33) n = 32 | 11.06 (0.37) n = 32 | 11.03 (0.29) n = 32 | 11.12 (0.30) n = 32 | 11.07 (0.33) n = 32 | 11.08 (0.30) n = 31 |
| sE-Selectin | 4.20 (0.19) n = 32 | 4.21 (0.28) n = 32 | 4.12 (0.25) n = 32 | 4.19 (0.33) n = 32 | 4.22 (0.26) n = 32 | 4.24 (0.36) n = 31 |
| sP-Selectin | 4.85 (0.30) n = 32 | 5.00 (0.47) n = 31 | 4.72 (0.28) n = 31 | 4.72 (0.30) n = 31 | 4.90 (0.48) n = 32 | 4.77 (0.35) n = 30 |
| sVCAM | 6.09 (0.18) n = 32 | 6.06 (0.15) n = 32 | 6.08 (0.17) n = 32 | 6.07 (0.19) n = 32 | 6.09 (0.24) n = 30 | 6.10 (0.17) n = 31 |
| TNF-α | 0.64 (0.48) n = 26 | 0.56 (0.54) n = 27 | 0.51 (0.49) n = 27 | 0.54 (0.39) n = 30 | 0.53 (0.46) n = 29 | 0.47 (0.43) n = 27 |

[*] w. b. = whole blood
[†] baseline is not available for $LTB_4$ measured using mass spectrometry
[‡] corr. for wbc = corrected for white blood cell count

TABLE 30

Treatment effect based on two sample t-test for the treatment groups, the pooled sets for the two highest doses and all doses (natural log scale).

| Assay | 250 mg/day (n = 64) | 500 mg/day (n = 64) | 750 mg/day (n = 63) | 500 & 750 mg/day (n = 127) | 250, 500 & 750 mg/day (n = 191) |
|---|---|---|---|---|---|
| Primary objectives | | | | | |
| Amyloid A | 0.03 [−0.09, 0.15] (p = 0.61) | −0.05 [−0.17, 0.06] (p = 0.36) | −0.01 [−0.011, 0.09] (p = 0.90) | −0.03 [−0.11, 0.05] (p = 0.43) | −0.01 [−0.07, 0.05] (p = 0.77) |
| Hs-CRP | 0.05 [−0.14, 0.24] (p = 0.59) | 0.09 [−0.09, 0.26] (p = 0.34) | 0.04 [−0.13, 0.21] (p = 0.66) | 0.06 [−0.06, 0.18] (p = 0.32) | 0.06 [−0.04, 0.16] (p = 0.26) |
| Lp-PLA$_2$ | 0.05 [−0.03, 0.12] (p = 0.24) | 0.03 [−0.04, 0.10] (p = 0.37) | 0.09 [0.03, 0.15] (p = 0.0056) | 0.06 [0.01, 0.10] (p = 0.012) | 0.05 [0.01, 0.09] (p = 0.0073) |
| LTB$_4$ in w. b.*, mass spec.[†] | −0.11 [−0.29, 0.06] (p = 0.19) | −0.09 [−0.28, 0.11] (p = 0.38) | −0.26 [−0.46, −0.06] (p = 0.010) | −0.17 [−0.31, −0.04] (p = 0.013) | −0.15 [−0.26, −0.05] (p = 0.0051) |
| LTB$_4$ in w. b.*, corr. for wbc[‡], m. s.[§] | −0.11 [−0.28, 0.05] (p = 0.18) | −0.08 [−0.26, 0.09] (p = 0.35) | −0.30 [−0.49, −0.11] (p = 0.0026) | −0.19 [−0.32, −0.06] (p = 0.0042) | −0.16 [−0.27, −0.06] (p = 0.0018) |
| LTB$_4$ in whole blood[†] | −0.13 [−0.35, 0.09] (p = 0.24) | −0.19 [−0.44, 0.06] (p = 0.13) | −0.30 [−0.56, −0.04] (p = 0.025) | −0.24 [−0.42, −0.07] (p = 0.0073) | −0.21 [−0.34, −0.07] (p = 0.0036) |
| LTB$_4$ in w. b.*, corr. for wbc[†,‡] | −0.13 [−0.35, 0.08] (p = 0.22) | −0.18 [−0.42, 0.05] (p = 0.12) | −0.34 [−0.59, −0.09] (p = 0.0089) | −0.26 [−0.43, −0.09] (p = 0.0027) | −0.22 [−0.35, −0.08] (p = 0.0014) |
| LTE$_4$ in urine | 0.14 [0.03, 0.24] (p = 0.011) | 0.15 [0.05, 0.24] (p = 0.0030) | 0.24 [0.14, 0.34] (p = 0.00002) | 0.19 [0.12, 0.26] (p < 0.00001) | 0.17 [0.12, 0.23] (p < 0.00001) |
| MPO in plasma | −0.07 [−0.22, 0.07] (p = 0.32) | 0.08 [−0.04, 0.21] (p = 0.20) | −0.04 [−0.17, 0.09] (p = 0.49) | 0.02 [−0.07, 0.11] (p = 0.68) | −0.01 [−0.09, 0.06] (p = 0.76) |
| MPO in whole blood[†] | 0.01 [−0.08, 0.11] (p = 0.78) | −0.01 [−0.13, 0.11] (p = 0.85) | −0.11 [−0.22, 0.00] (p = 0.056) | −0.06 [−0.14, 0.02] (p = 0.14) | −0.04 [−0.10, 0.03] (p = 0.27) |
| MPO in w. b.*, corr. for wbc[‡] | 0.01 [−0.08, 0.11] (p = 0.76) | 0.00 [−0.11, 0.12] (p = 0.94) | −0.13 [−0.24, −0.02] (p = 0.023) | −0.06 [−0.14, 0.02] (p = 0.12) | −0.04 [−0.10, 0.02] (p = 0.24) |
| N-tyrosine | −0.03 [−0.15, 0.09] (p = 0.60) | −0.03 [−0.13, 0.08] (p = 0.60) | 0.03 [−0.08, 0.14] (p = 0.56) | 0.00 [−0.07, 0.08] (p = 0.96) | −0.01 [−0.07, 0.05] (p = 0.78) |
| Tertiary objectives | | | | | |
| ICAM | 0.00 [−0.04, 0.03] (p = 0.83) | 0.00 [−0.04, 0.03] (p = 0.81) | −0.03 [−0.06, 0.00] (p = 0.025) | −0.02 [−0.04, 0.00] (p = 0.10) | −0.01 [−0.03, 0.01] (p = 0.16) |
| IL12p40 | 0.01 [−0.04, 0.06] (p = 0.69) | 0.02 [−0.04, 0.08] (p = 0.53) | 0.01 [−0.04, 0.06] (p = 0.70) | 0.01 [−0.02, 0.05] (p = 0.46) | 0.01 [−0.02, 0.04] (p = 0.40) |
| IL6 | −0.02 [−0.13, 0.09] (p = 0.68) | 0.06 [−0.03, 0.16] (p = 0.19) | −0.01 [−0.10, 0.09] (p = 0.87) | 0.03 [−0.04, 0.09] (p = 0.40) | 0.01 [−0.05, 0.07] (p = 0.69) |
| MCP-1 | −0.02 [−0.07, 0.03] (p = 0.51) | 0.02 [−0.03, 0.08] (p = 0.35) | −0.03 [−0.08, 0.03] (p = 0.32) | 0.00 [−0.04, 0.04] (p = 0.98) | −0.01 [0.04, 0.02] (p = 0.69) |
| MMP 9 | −0.03 [−0.12, 0.05] (p = 0.47) | 0.02 [−0.06, 0.11] (p = 0.58) | −0.02 [−0.11, 0.06] (p = 0.60) | 0.00 [−0.06, 0.06] (p = 0.97) | −0.01 [−0.06, 0.04] (p = 0.69) |
| Oxidized - LDL | 0.00 [−0.08, 0.07] (p = 0.91) | 0.02 [−0.07, 0.11] (p = 0.65) | 0.06 [−0.03, 0.16] (p = 0.16) | 0.04 [−0.02, 0.11] (p = 0.18) | 0.03 [−0.02, 0.08] (p = 0.28) |
| sE-Selectin | 0.03 [−0.03, 0.09] (p = 0.30) | −0.01 [−0.06, 0.04] (p = 0.82) | −0.04 [−0.09, 0.01] (p = 0.11) | −0.02 [−0.06, 0.01] (p = 0.20) | 0.00 [−0.04, 0.03] (p = 0.75) |
| sP-Selectin | −0.02 [−0.11, 0.06] (p = 0.58) | 0.00 [−0.08, 0.08] (p = 0.97) | 0.09 [0.01, 0.16] (p = 0.034) | 0.04 [−0.02, 0.10] (p = 0.15) | 0.02 [−0.03, 0.07] (p = 0.40) |
| sVCAM | 0.00 [−0.05, 0.04] (p = 0.85) | −0.01 [−0.06, 0.04] (p = 0.60) | −0.03 [−0.07, 0.02] (p = 0.24) | −0.02 [−0.05, 0.01] (p = 0.24) | −0.01 [−0.04, 0.01] (p = 0.28) |
| TNF-α | 0.00 [−0.08, 0.09] (p = 0.93) | −0.02 [−0.10, 0.07] (p = 0.70) | 0.01 [−0.07, 0.08] (p = 0.85) | 0.00 [−0.06, 0.06] (p = 0.90) | 0.00 [−0.05, 0.05] (p = 0.95) |

*w. b. = whole blood
[†]measurement is not part of the primary analysis wrt adjustment for multiple testing
[‡]corr. for wbc = corrected for white blood cell count
[§]m. s. = mass spec. = mass spectrometry Tests for Carry-Over Effects A test for carry-over effects from the treatment phase to the placebo phase was performed as a two-sample t-test on the differences between visit 2 and 5 for patients on drug and placebo, respectively. The cohort taking drug consists of patients on 500 mg/day and 750 mg/day treatment and the placebo cohort includes patients on placebo from all 3 tracks. The resulting p-values and confidence intervals for the effect are given in Table 31 (data were not available for Lp-PLA$_2$ and N-tyrosine). No carry over effects were observed with LTB$_4$ and MPO. In contrast, marked carry over effects were observed for CRP and SAA, with reduction in CRP that was significant at the 5% level (p=0.017). SAA showed similar carry over effects that was slightly below this significance level (p=0.051).

TABLE 31

Test for carry-over effect for each study period.

| Assay | p-value | Effect | 95% CI |
|---|---|---|---|
| CRP | 0.017 | −0.28 | [−0.52, −0.05] |
| Amyloid A | 0.051 | −0.14 | [−0.29, 0.00] |
| LTE$_4$ in urine | 0.48 | −0.06 | [−0.22, 0.10] |
| MCP-1 | 0.084 | 0.07 | [−0.01, 0.15] |
| MMP 9 | 0.56 | −0.04 | [−0.16, 0.09] |
| MPO in plasma | 0.28 | −0.11 | [−0.31, 0.09] |
| White blood cell count | 0.57 | −0.01 | [−0.06, 0.03] |
| LTB$_4$ in whole blood, corr. for wbc[‡] | 0.45 | −0.10 | [−0.36, 0.16] |
| MPO in whole blood, corr. for wbc[‡] | 0.93 | 0.01 | [−0.13, 0.15] |

TABLE 31-continued

Test for carry-over effect for each study period.

| Assay | p-value | Effect | 95% CI |
|---|---|---|---|
| $LTB_4$ in whole blood, mass spec.§ | 0.45 | 0.19 | [−0.33, 0.71] |
| $LTB_4$ in whole blood, corr. for wbc,‡ m.s.§ | 0.64 | 0.12 | [−0.40, 0.64] |

Figure 9:
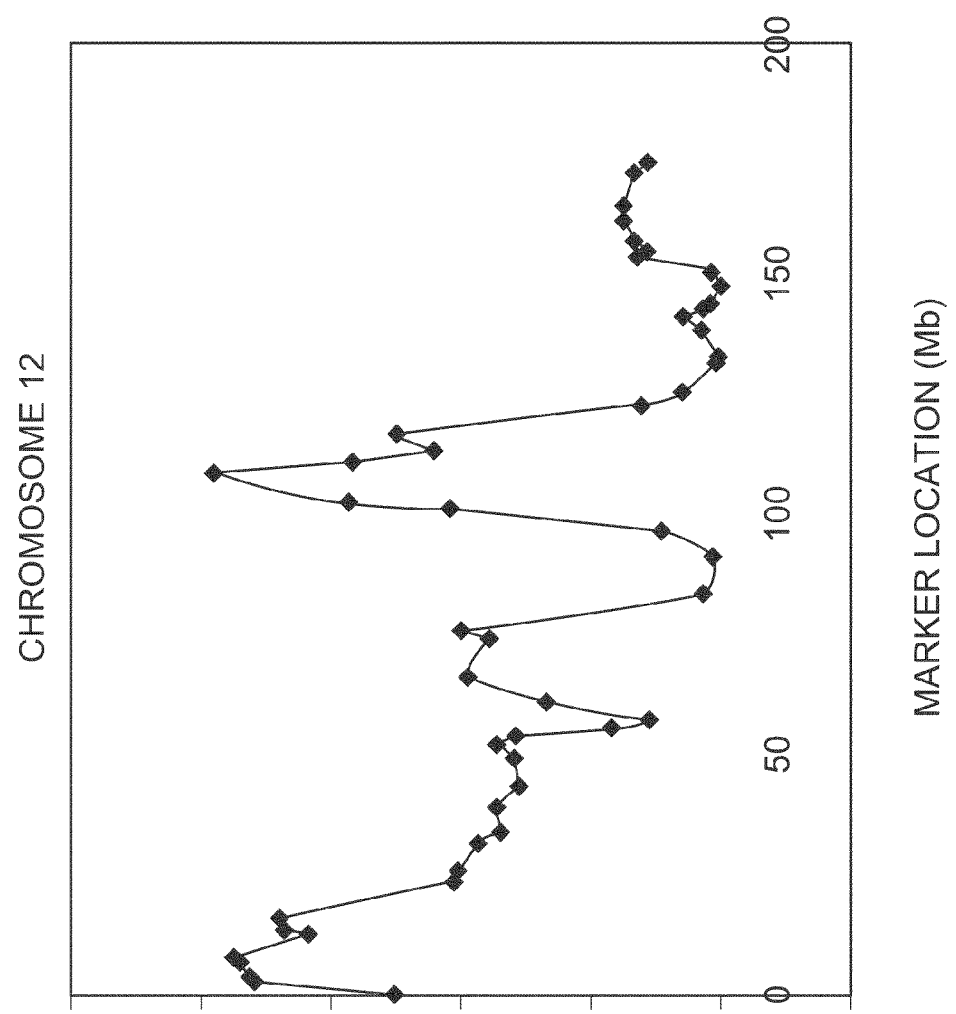
FIG. 9 shows the results of the first step of the linkage analysis: multipoint non-parametric LOD scores for a framework marker map on chromosome 12. A LOD score suggestive of linkage of 1.95 was found at marker D12S2081.
Figure 10:
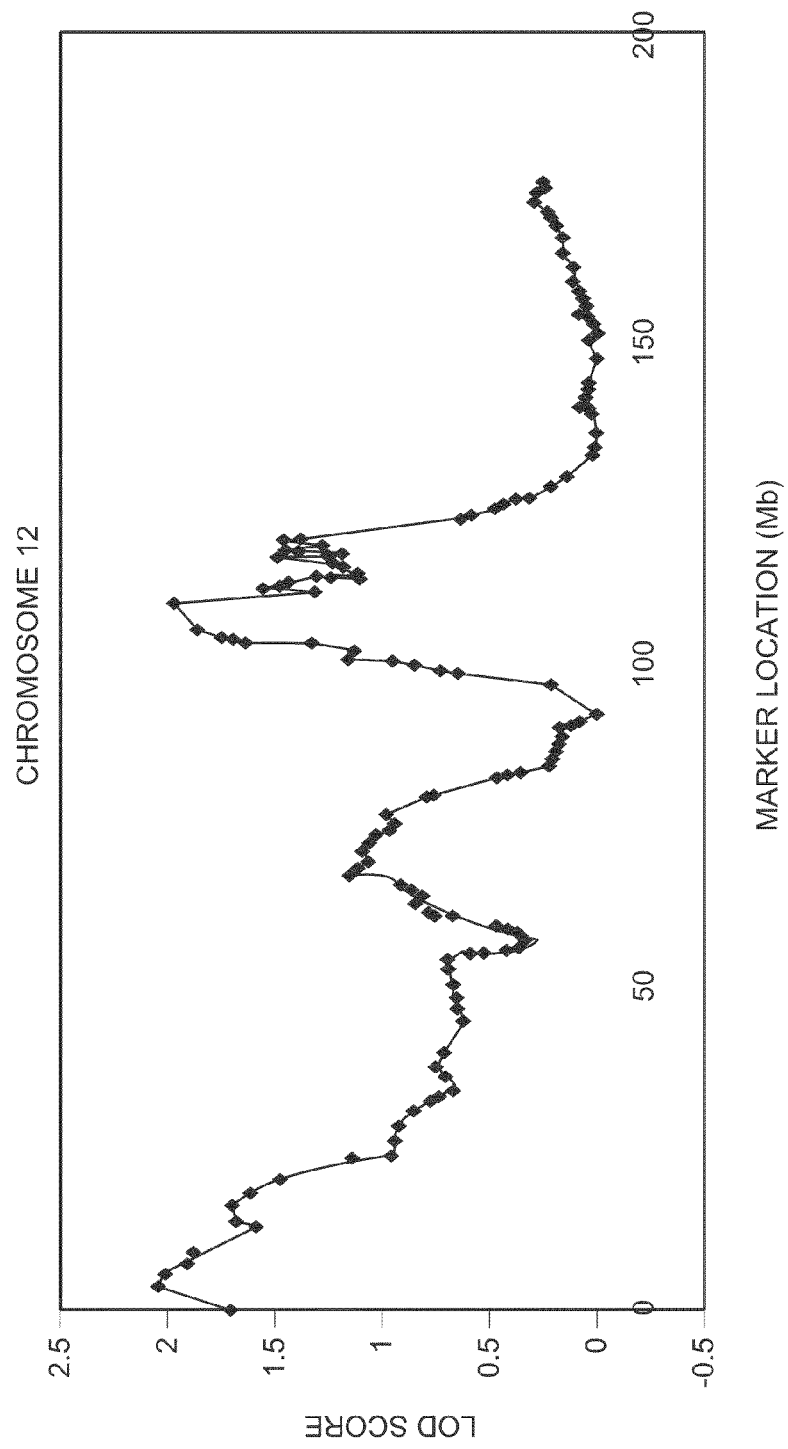
FIG. 10 shows the results of the second step of the linkage analysis: multipoint non-parametric LOD scores for the families after adding 20 fine mapping markers to the candidate region. The inclusion of additional microsatellite markers increased the information on sharing by decent from 0.8 to 0.9, around the markers that gave the highest LOD scores.

‡corr. for wbc = corrected for white blood cell count
§m.s. = mass spec. = mass spectrometry FIG. 9 shows the estimated mean effects on CRP and SAA for the subjects receiving the two higher drug doses in the first period. Note that measurements from subjects receiving the placebo first also contribute to these estimates to cancel out potential seasonal effects. For visits 3 (after 2 weeks on therapy) and 4 (after 4 weeks on therapy), this constitutes the treatment effect, whereas the carry-over effects appear between visits 5 to 7.

The level of CRP dropped at visits 3 and 4, but not significantly. The reduction became more pronounced, about 25%, and significant at visit 5 (p=0.017), and seems to persists until visit 7, during the time the subjects were on placebo. This prolonged effect is part of the reason that the drug effect was not detected in the primary analysis which did not take this scenario into account. The design of this trial does not have maximal power for studying such effects which is reflected by the large standard errors in the estimates, particularly for visits 6 and 7. Even though measurements at visits 3 and 6 are not available for SAA, the observed changes of CRP and Amyloid A between visits 2 and 5 are highly correlated (r=0.68, p<0.00001). Hence it appears that the drug has similar effects on both biomarkers.

No difference was detected in the effects of DG-031 on biomarkers of MI risk between patients with FLAP or LTA4 hydrolase haplotypes when the data were analysed separately.

There was no difference in serious adverse events between the treatment groups or dose arms in the study cohort. In particular, no difference was detected in liver transaminases between the groups on active drug or placebo. The only symptom that was significantly more often reported for active drug was dizziness, experienced by 6 patients on active drug (any dose) and none on placebo (p=0.032). This did not interfere with the daily activities of the subjects.

When taken together, the data generated through the MI gene-isolation (Example 1) and the clinical trial reported herein, show that DG031 is a safe and well tolerated drug that can, at least in part, correct a biochemical defect that confers a relative risk of acute cardiovascular events that is similar to or greater than the risk conferred by the top quintile of LDL cholesterol. Indeed, the data suggest that DG-031 reduces serum levels of CRP and SAA by approximately 25%, suggesting that this will cause reduction in the risk of acute cardiovascular events.

EXAMPLE 11

Clinical Trial Investigating the Effect of Compositions Comprising a Leukotriene Synthesis Inhibitor and a Statin on Biomarkers of Risk of Myocardial Infarction A randomized, placebo-controlled crossover-clinical trial, as described in Example 10, is carried out to investigate the effect of compositions comprising a leukotriene synthesis inhibitor and a statin on the levels of biomarkers of risk of MI. The participants for the study optionally are carriers of variants in the FLAP and/or $LTA_4$ hydrolase genes set out in Table 25. One group of participants receives a leukotriene synthesis inhibitor alone, such as DG031. Another group of participants receives a statin alone. A third group of participants receives a composition comprising both a leukotriene synthesis inhibitor and a statin. The forth group of participants receives a placebo.

Each participant receives the treatment for at least two months and the levels of biomarkers set out in Table 28 are monitored in each participant for at least three months. It is expected that the group receiving a leukotriene synthesis inhibitor alone will have a 25% decrease in CRP levels and the group receiving a statin alone will also have a 25% decrease in CRP levels. More substantial decrease in CRP from combination therapy is evidence that the combination therapy is beneficial. In view of the data from the clinical trial described in Example 10, wherein almost all (about 85%) of the participants were on statin therapy, it is expected that the group receiving the combination therapy will exhibit a 50% decrease in CRP levels.

EXAMPLE 12

Association of Variants in the Gene Encoding ALOX5AP/FLAP to MI in a North American Population As described in Example 1, a variant in the gene encoding 5-Lipoxygenase activating protein (ALOX5AP/FLAP) confers risk to both MI and stroke in Iceland. Another SNP-based haplotype within ALOX5AP, HapB, showed significant association to MI in British cohorts as described in Example 9. Using similar techniques, the association between HapA and HapB and MI in a North American ("Cleveland") cohort was analyzed.

The ALOX5AP haplotype HapA is also associated to MI in a North-American population. The SNPs defining HapA (SG13S25, SG13S114, SG13S89, and SG13S32) and HapB (SG13S377, SG13S114, SG13S41 and SG13S35) were genotyped in 696 MI patients (553 males and 143 females) and 698 controls (314 males and 384 females). The majority of the study subjects were Caucasians and approximately 10% were African American. Information on the ethnicity at an individual level was not available.

The SNP haplotype analysis was done using the program NEMO (Gretarsdottir et al., *Nat Genet* 35:131-8, 2003). NEMO handles missing genotypes and uncertainty with phase through a likelihood procedure, using the expectation-maximization algorithm as a computational tool to estimate haplotype frequencies. For the at-risk haplotypes we calculated the relative risk (RR) assuming a multiplicative model (Falk & Rubinstein P Ann Hum Genet 51 (Pt 3):227-33, 1987: Terwilliger & Ott Hum Hered. 42:337-46, 1992) in which the risk of the two alleles of haplotypes a person carries multiply.

The results of the haplotype association analysis for HapA and HapB are shown in Table 32. As demonstrated in the Icelandic population (see Example 1), the estimated frequency of HapA was significantly greater in the patient group than in the control group. In the total cohort, the allelic/haplotype frequency of HapA was 16.9% and 13.6% in patients and controls respectively (P=0.014), which corresponds to a 29% increase in risk of MI for each copy of HapA carried. The relative risk of MI in the total group was 1.29 and a P-value for the association was 0.014. In addition, HapA was overrepresented in patients who had experienced an MI relatively early in life (males before the age of 55 and females before the age of 65). As shown in Table 32, the relative risk of early onset MI (males before the age of 55 and females before the age of 65) was 1.61 and the P-value for the association was 0.0034.

TABLE 32

Association of HapA and HapB with MI

| Phenotype (n) | HapA | | | HapB | | |
|---|---|---|---|---|---|---|
| | Frequency | RR | P | Frequency | RR | P |
| Total cohort | | | | | | |
| Controls (698) | 0.136 | | | 0.074 | | |
| MI (696) | 0.169 | 1.29 | 0.014 | 0.081 | 1.1 | NS |
| Early onset (170) | 0.205 | 1.61 | 0.0034 | | | |

This analysis was repeated in three additional North American cohorts from Philadelphia and two from Atlanta (referred to Emory cohort 1 and Emory cohort 2). A comparison of the data from European Americans and African Americans is provided as Table 33 below. The combined data for European-Americans (Caucasians) in the North American cohorts (Cleveland, Philadelphia and Atlanta), indicated that the allelic/haplotype frequence of HapA was 16.5% in patients and 15% in controls (P=0.04). The relative risk of MI in the total North American patients of European ancestry was 1.13. In African-Americans within the combined North American cohorts, the allelic/haplotype frequencies of HapA was 12.4% in patients and 9.5% in controls (P=0.06). The relative risk of MI in the total of African Americans was 1.4. Even though the frequency of HapA was less in the African American members of the cohort, the relative risk was higher. The results from this analysis indicate that African Americans are an especially promising target population for the anti-leukotriene therapies described herein. At risk individuals of black African origin that exhibits HapA or other risk factors described herein are specifically contemplated for prophylaxis therapy according to the invention described herein.

TABLE 33

| | p-val | r | #aff | aff. freq | #con | con.freq |
|---|---|---|---|---|---|---|
| European Americans | | | | | | |
| Philadelphia cohort | 0.439 | 0.9076 | 723 | 0.159247 | 428 | 0.17265 |
| Cleveland cohort | 0.114 | 1.1998 | 627 | 0.163285 | 777 | 0.1399 |
| Emory cohort 1 | 0.196 | 1.2259 | 236 | 0.16713 | 637 | 0.14067 |
| Emory cohort 2 | 0.342 | 1.1855 | 292 | 0.179848 | 291 | 0.1561 |
| African Americans | | | | | | |
| Philadelphia cohort | 0.365 | 0.7228 | 105 | 0.085406 | 125 | 0.11441 |
| Cleveland cohort | 0.163 | 1.7542 | 53 | 0.157175 | 110 | 0.09609 |
| Emory cohort 1 | 0.036 | 2.4673 | 39 | 0.169904 | 161 | 0.0766 |
| Emory cohort 2 | 0.336 | 1.4262 | 69 | 0.145303 | 146 | 0.10651 |

The association of HapB to MI in the study cohort was also studied. HapB has previously been shown to confer risk of MI in an English cohort (see Example 9). A slight excess of HapB was observed in the total patient group (8.1%) compared to all controls (7.4%), but it was not significant (Table 32).

Analysis of HapB was also repeated in three additional North American cohorts from Philadelphia and two from Atlanta (referred to Emory cohort 1 and Emory cohort 2). A comparison of the data from European Americans and African Americans is provided as Table 34 below. The combined data for European-Americans (Caucasians) within the North American cohorts (Cleveland, Philadelphia and Atlanta), indicated that the allelic/haplotype frequence of HapB was 7.4% in patients and 6.2% in controls (P=0.03). The relative risk of MI in the total North American patients of European ancestry was 1.22. In African-Americans in the combined North American cohorts, the allelic/haplotype frequencies of HapB was 12.6% in patients and 14.4% in controls (P=0.37) The relative risk of MI in the total of African Americans was 0.857.

TABLE 34

| | p-val | r | #aff | aff. freq | #con | con.freq |
|---|---|---|---|---|---|---|
| European Americans | | | | | | |
| Philadelphia cohort | 0.541 | 1.1176 | 724 | 0.077524 | 428 | 0.06994 |
| Cleveland cohort | 0.026 | 1.4371 | 627 | 0.08299 | 778 | 0.05924 |
| Emory cohort 1 | 0.78 | 1.0853 | 236 | 0.058363 | 633 | 0.05403 |
| Emory cohort 2 | 0.47 | 0.825 | 266 | 0.057363 | 296 | 0.0687 |
| African Americans | | | | | | |
| Philadelphia cohort | 0.645 | 1.1394 | 105 | 0.150802 | 126 | 0.13484 |
| Cleveland cohort | 0.604 | 0.8195 | 53 | 0.115501 | 109 | 0.13744 |
| Emory cohort 1 | 0.429 | 0.6995 | 39 | 0.099588 | 160 | 0.13653 |
| Emory cohort 2 | 0.126 | 0.588 | 62 | 0.102502 | 148 | 0.16264 |

This analysis demonstrated that an ALOX5AP haplotype, HapA, previously reported to confer risk of MI and stroke in an Icelandic cohort (Example 1), and to stroke in a Scottish cohort (described below in Example 14), associates with MI in an North-American population. HapB that confers risk of MI in an British cohort (Example 9) also conferred risk of MI in Caucasians in this North-American cohort.

EXAMPLE 13

Additional ALOX5AP/FLAP Haplotype Associated with MI in a North American Population From the analysis of the Cleveland cohort described in Example 12, another haplotype was identified which significantly associated with MI. This haplotype is denoted as HapC, and 5 variations of this haplotype were identified (HapC1, HapC2, HapC3, HapC4-A, HapC4-B). These haplotypes show the most significant association to MI in the Cleveland cohort.

These haplotypes are defined in Table 35. HapC1 is the T allele of marker SG13S375. HapC2 has T allele of marker SG13S375 and the G allele of SG13S25. HapC3 adds allele A of SG13S32 plus T allele of marker SG13S375 and the G allele of SG13S25. The addition of the fourth SNP or SG13S106 splits HapC3 into two parts, or HapC4-A and HapC4-B. Allele G of SNP SG13S25, which is in HapC2, HapC3, HapC4-A and HapC4-B is also a characteristic of HapA.

The frequency of HapC1, HapC2, HapC3 and HapC4-A and HapC4-B in different populations are shown in the Table 35. HapC1, HapC2, and HapC3 are over-represented in the patient groups in all populations tested. In the Iceland and UK cohors studied, the HapC4-A part of HapC3 seems to be the one that captures all of the risk conferred by HapC3.

All HapC variants except HapC4-B are correlated with HapA, meaning the chromosomes that carry HapC also tend to carry HapA. The correlation between HapC4-A and HapA is defined by a correlation coefficient ($R^2$) of 0.52; the linkage disequilibrium (D') of 0.77 and the P-value (measure of significance) of 6.4×10−312. HapC is also correlated with HapB, although HapA and HapB are negatively correlated. The correlation between HapC4-A and HapB haplotypes is defined by a correlation coefficient ($R^2$) of 0.08; the linkage disequilibrium (D') of 0.05 and the P-value of 2.2×10−39.

TABLE 35

Total Cleveland Cohort

| Haplotype | p-value | RR | # of Affected | Aff. Frequency | # of Controls | Control Frequency | Info | SG13S375 | SG13S25 | SG13S106 | SG13S32 |
|---|---|---|---|---|---|---|---|---|---|---|---|
| HapC1 | 0.002089 | 1.385 | 666 | 0.86036 | 662 | 0.816465 | 1 | T | | | |
| HapC2 | 0.000416 | 1.3722 | 683 | 0.774968 | 671 | 0.715071 | 1 | T | G | | |
| HapC3 | 0.000148 | 1.4012 | 695 | 0.346955 | 695 | 0.274923 | 0.9 | T | G | | A |
| HapC4-A | 0.038937 | 1.2662 | 696 | 0.184999 | 698 | 0.152022 | 0.8 | T | G | G | A |
| HapC4-B | 0.003222 | 1.4174 | 696 | 0.166372 | 698 | 0.123424 | 0.8 | T | G | A | A |

| Haplotype | P-value | RR | # of Affected | Aff. Frequency | # of Controls | Control Frequency | Info | SG13S375 | SG13S25 | SG13S106 | SG13S32 |
|---|---|---|---|---|---|---|---|---|---|---|---|
| United Kingdom Cohort | | | | | | | | | | | |
| HapC1 | 3.00E−01 | 1.15 | 559 | 0.894 | 591 | 0.881 | 1 | T | | | |
| HapC2 | 6.40E−02 | 1.2 | 741 | 0.808 | 708 | 0.778 | 0.9 | T | G | | |
| HapC3 | 3.90E−02 | 1.2 | 747 | 0.341 | 719 | 0.302 | 0.8 | T | G | | A |
| HapC4-A | 1.10E−02 | 1.31 | 749 | 0.21 | 721 | 0.169 | 0.8 | T | G | G | A |
| HapC4-B | 8.90E−01 | 1.02 | 749 | 0.134 | 721 | 0.132 | 0.7 | T | G | A | A |
| Iceland MI Cohort | | | | | | | | | | | |
| HapC1 | 2.90E−01 | 1.14 | 645 | 0.886 | 575 | 0.872 | 1 | T | | | |
| HapC2 | 1.10E−01 | 1.16 | 774 | 0.756 | 612 | 0.728 | 0.9 | T | G | | |
| HapC3 | 4.50E−02 | 1.19 | 775 | 0.33 | 618 | 0.292 | 0.9 | T | G | | A |
| HapC4-A | 8.00E−04 | 1.5 | 777 | 0.169 | 622 | 0.119 | 0.8 | T | G | G | A |
| HapC4-B | 5.40E−01 | 0.93 | 777 | 0.162 | 622 | 0.172 | 0.9 | T | G | A | A |
| Iceland Stroke Cohort | | | | | | | | | | | |
| HapC1 | 4.80E−01 | 1.09 | 683 | 0.881 | 575 | 0.872 | 1 | T | | | |
| HapC2 | 2.90E−01 | 1.1 | 697 | 0.749 | 612 | 0.73 | 0.9 | T | G | | |
| HapC3 | 1.90E−02 | 1.23 | 700 | 0.343 | 618 | 0.297 | 0.9 | T | G | | A |
| HapC4-A | 1.90E−04 | 1.58 | 702 | 0.181 | 622 | 0.122 | 0.8 | T | G | G | A |
| HapC4-B | 4.70E−01 | 0.92 | 702 | 0.16 | 622 | 0.171 | 0.9 | T | G | A | A |

Analysis of HapC4A was repeated in four additional North American cohorts from Philadelphia and from Atlanta (referred to as Emory Cohort 1). A comparison of the data from European Americans and African Americans is provided as Table 36 below. The combined data for European-Americans (Caucasians) in the North American cohorts (Cleveland, Philadelphia and Atlanta), indicated that the allelic/haplotype frequence of HapC4A was 17.99% in patients and 17.1% in controls (P=0.18). The relative risk of MI in the total North American patients of European ancestry was 1.06. In African-Americans within the combined North American cohorts, the allelic/haplotype frequencies of HapC4A was 12.96% in patients and 10.62% in controls (P=0.14). The relative risk of MI in the total of African Americans was 1.25. Even though the frequency of HapC4A was less in the African American members of the cohort, the relative risk was higher. The results from this analysis indicate that African Americans are an especially promising target population for the anti-leukotriene therapies described herein. At risk individuals of black African origin that exhibits HapC4A or other risk factors described herein are specifically contemplated for prophylaxis therapy according to the invention described herein.

TABLE 36

| | p-val | r | #aff | aff. freq | #con | con.freq |
|---|---|---|---|---|---|---|
| European Americans | | | | | | |
| Philadelphia | 0.117 | 0.82 | 722 | 0.166 | 424 | 0.195 |
| Cleveland | 0.052 | 1.24 | 627 | 0.189 | 777 | 0.158 |
| Emory 1 | 0.401 | 1.14 | 236 | 0.196 | 638 | 0.177 |
| Emory 2 | NA | | | | | |

TABLE 36-continued

| | p-val | r | #aff | aff. freq | #con | con.freq |
|---|---|---|---|---|---|---|
| African Americans | | | | | | |
| Philadelphia | 0.512 | 0.79 | 105 | 0.099 | 126 | 0.121 |
| Cleveland | 0.327 | 1.50 | 53 | 0.144 | 110 | 0.100 |
| Emory 1 | 0.086 | 2.02 | 39 | 0.181 | 158 | 0.098 |
| Emory 2 | NA | | | | | |

EXAMPLE 14

Association of Variants in the Gene Encoding ALOX5AP/FLAP to Stroke in a Scottish Population Analysis of HapA and HapB haplotypes was carried out in a Scottish cohort as described in Example 1 and 9. The SNPs defining HapA (SG13S25, SG13S114, SG13S89, and SG13S32) and HapB (SG13S377, SG13S114, SG13S41 and SG13S35) were genotyped in 450 Scottish stroke patients and 710 controls. The patient and control cohorts have been described previously (MacLeod et al., Neurology 53:418-20, 1999; Meiklejohn et al., Stroke 32:57-62, 2001; Duthie et al., Am J Clin. Nutr. 75:908-13, 2002; Whalley et al., Am J Clin. Nutr., 2004). In brief, 450 patients from North East Scotland with CT confirmation of ischemic stroke (including 26 patients with transient ischemic attack (TIA)) were recruited between 1997 and 1999, within one week of admission to the Acute stroke unit at Aberdeen Royal Infirmary. Patients were further subclassified according to the TOAST research criteria (Adams et al., Stroke 24:35-41, 1993). One hundred and fifty five patients (34%) had large vessel stroke, 96 (21.3%) had cardiogenic stroke and 109 (24.2%) had small vessel stroke. In 5 cases (1.1%) stroke with other determined etiology was diagnosed, 7 (1.5%) had more than one etiology, and 78 (17.3%) had unknown cause of stroke despite extensive evaluation. Seven hundred and ten controls with no history of stroke or TIA were recruited as a part of the 1921 (n=227) and 1936 (n=371) Aberdeen Birth Cohort Studies (Duthie et al., Am. J. Clin. Nutr. 75:908-13, 2002; Whalley et al., Am J Clin. Nutr., 2004), and from primary care (n=112) (Meiklejohn et al., Stroke 32:57-62, 2001).

The SNP haplotype analysis was done using the program NEMO (Gretarsdottir et al., Nat Genet 35:131-8, 2003). NEMO handles missing genotypes and uncertainty with phase through a likelihood procedure, using the expectation-maximization algorithm as a computational tool to estimate haplotype frequencies. As the two haplotypes tested had previously been shown to confer risk of MI and stroke in an Icelandic cohort, and MI in an English cohort, the reported P-values are one-sided. For the at-risk haplotypes we calculated the relative risk (RR) assuming a multiplicative model (Falk & Rubinstein P Ann Hum Genet 51 (Pt 3):227-33, 1987: Terwilliger & Ott Hum Hered. 42:337-46, 1992) in which the risk of the two alleles of haplotypes a person carries multiply.

The results of the haplotype association analysis for HapA and HapB are shown in Table 37. The haplotype frequencies of HapA in the Scottish stroke and control populations were higher than in the corresponding Icelandic populations. As demonstrated in the Icelandic population, the estimated frequency of HapA was significantly greater in Scottish stroke patients than in Scottish controls. The carrier frequency of HapA in Scottish patients and controls were 33.4% and 26.4%, respectively, resulting in a relative risk of 1.36 (P=0.007) and a corresponding PAR 9.6%. In the Icelandic population, a higher frequency of HapA was observed in male patients when compared to female patients with either stroke or MI. This gender difference in the frequency of HapA was not observed in the Scottish population.

TABLE 37

Association of HapA and HapB with ischemic stroke

| Phenotype (n) | HapA | | | HapB | | |
|---|---|---|---|---|---|---|
| | Frequency | RR | P-value | Frequency | RR | P-value |
| Scotland | | | | | | |
| Controls (710) | 0.142 | | | 0.058 | | |
| Ischemic stroke (450)$^a$ | 0.184 | 1.36 | 0.007 | 0.068 | 1.20 | NS |
| Males (253) | 0.183 | 1.35 | 0.023 | 0.092 | 1.65 | 0.016 |
| Females (181) | 0.179 | 1.34 | 0.044 | 0.035 | 0.58 | NS |
| Iceland | | | | | | |
| Controls (624) | 0.095 | | | 0.07 | | |
| Ischemic stroke (632) | 0.147 | 1.63 | 0.00013 | 0.073 | 1.09 | NS |
| Males (335) | 0.155 | 1.75 | 0.0002 | 0.086 | 1.31 | NS |
| Females (297) | 0.138 | 1.51 | 0.0079 | 0.058 | 0.86 | NS |

The association of HapB to stroke in the Scottish cohort was also investigated. HapB has previously been shown to confer risk of MI in an English cohort (Example 9). A slight excess of HapB was observed in the patient group (6.8%) compared to controls (5.8%), but it was not significant (Table 37). However, gender specific analysis showed that the frequency of HapB was higher in males with ischemic stroke (9.2%) than in controls, resulting in a RR of 1.65 (P=0.016). The frequency of HapB in females with ischemic stroke was 3.5% which was lower but not significantly different from controls. The frequencies of HapB in males and females with ischemic stroke differed significantly (P=0.0021). As shown in Table 37, similar trends were observed in our Icelandic cohort; the frequency of HapB being greater in males with ischemic stroke (8.6%) than in females with ischemic stroke (5.8%), although this was not significant (P=0.055).

Thus, HapA, the risk haplotype of ALOX5AP, associates with ischemic stroke in a Scottish cohort. HapB was not associated with ischemic stroke in the Scottish cohort. However, HapB was overrepresented in male patients.

EXAMPLE 15

Identification of LTA4H Haplotypes Associated with MI Study Population

Patients entering the study were defined from a myocardial infarction (MI) registry that includes all MIs (over 8,000 patients) in Iceland from 1981 to 2002. This registry is a part of the World Health Organization MONICA Project (The World Health Organization MONICA Project (monitoring trends and determinants in cardiovascular disease): a major international collaboration. WHO MONICA Project Principal Investigators. *J Clin. Epidemiol.* 1988; 41:105-14). Diagnosis of all patients in the registry follow strict diagnostic rules based on symptoms, electrocardiograms, cardiac enzymes, and necropsy findings.

Blood samples from over 1500 MI patients, both cases with a family history and sporadic cases were collected. For each patient that participated, blood was collected from 2 relatives (unaffected or affected). Their genotypes were used to help with construction of haplotypes. Blood samples from over 950 controls were also collected. The control cohort was population based.

Linkage Analysis

In an effort to enrich for those patients who had stronger genetic factors contributing to their risk for MI, we fractionated the MI cohort to those patients with earlier onset MI. We chose different age cutoffs for male and females since the average age of MI in females is 10 years older than for males. Using MI onset at age less than 50 in males and less than 60 in females, 196 patients were clustered within 67 Pedigrees. These pedigrees included related earlier onset MI patients such that each patient is related to at least one other patient up to and including six meiotic events. The information regarding the relatedness of patients was obtained from an encrypted genealogy database that covers the entire Icelandic nation (Gulcher et al., *Eur. J. Hum. Genet.* 8: 739-742 (2000)). A genome-wide scan was performed using a framework map of 1000 microsatellite markers, using protocols described elsewhere (Gretarsdottir S., et al. *Am. J. Hum. Genet.,*70: 593-603, 2002)). The marker order and positions were obtained from deCODE genetic's high resolution genetic map (Kong A, et al., *Nat. genet.,* 31: 241-247 (2002)). All markers used in the linkage analysis are publicly available microsatellite markers. The population-based allele frequencies were constructed from a cohort of more than 30,000 Icelanders who have participated in genetic studies of various disease projects.

For statistical analysis, multipoint, affected only allele-sharing methods were used to assess evidence for linkage. All results, both the LOD and the non-parametric linkage (NPL) score, were obtained using the program ALLEGRO (Gudbjartsson D. F., et al., *Nat Genet.,* 25:12-13(2000)). The baseline linkage analysis (Gretarsdottir S., et al., *Am. J. Hum. Genet.* 70: 593-603, (2002)) uses the Spairs scoring function (Whittermore AS, and Haplem J A., *Biometrics* 50: 118-127 (1994)) and Kruglyak et al., *Am. J. Hum. Genet.,* 58:1347-

1363 (1996)) the exponential allele-sharing model (Kong A., and Cox N. J., *Am. J. Hum. Genet.* 61:1179-1188 (1997)), and a family weighting scheme which is halfway, on the log-scale, between weighing each affected pairs equally and weighing each family equally.

Fine Mapping

A candidate susceptibility locus was defined as the region under the LOD score curve where the score was one lower than the highest lod score ((peak lod score-1)\one lod drop). This region (approx. 12 Mb) was finemapped with microsatellite markers with an average spacing between markers of approximately 1.5 cM.

Case-control Haplotype Association Analysis

A large case-control analysis was initially carried out using over 560 male MI patients and 338 female MI patients and 480 population-based controls in an effort to find the MI gene within the linkage peak on chromosome 12 found in genome-wide linkage analysis. Given that a member of the leukotriene biosynthetic pathway, LTA4H, was near the peak microsatellite marker, an effort was made to identify microsatellite markers positioned close to, or within, the LTA4H gene. Three microsatellite markers were identified within the deCODE genetics modified assembly of the public UCSC human genome sequence assembly and they were subsequently genotyped. In addition, SNPs were identified within the LTA4H gene by sequencing 93 patients. Out of the 90 SNPs that were identified 12 were selected to genotype 894 patients and 462 controls. These three microsatellite markers and 12 SNPs, were subsequently used for haplotype analysis. Results from the initial haplotype analysis are shown in Table 41 and Table 42.

We then typed a subset of the markers on more MI patients and controls. This subset included 8 SNPs and 3 microsatellite markers. In addition, we typed 9 new SNPs on the total cohort which now included 1560 MI patients and 953 controls. Results from the haplotype association analysis, using the extended cohort and a total of 17 SNPs and 3 microsatellite markers, are shown in Table 41.

The frequencies of haplotypes in the patient and the control groups using an expectation-maximization algorithm were estimated (Dempster A. P. et al., *J. R. Stat. Soc. B.* 39: 1-389 (1977)). An implementation of this algorithm that can handle missing genotypes and uncertainty with the phase was used. Under the null hypothesis, the patients and the controls are assumed to have identical frequencies. Using a likelihood approach, an alternative hypothesis where a candidate at-risk-haplotype is allowed to have a higher frequency in patients than controls, while the ratios of the frequencies of other haplotypes are assumed to be the same in both groups was tested. Likelihoods are maximized separately under both hypothesis and a corresponding 1-df likelihood ratio statistics is used to evaluate the statistic significance.

To assess the significance of the haplotype association corrected for multiple testing, we carried out a randomisation test using the same genotype data. We randomised the cohorts of patients and controls and repeated the analysis. This procedure was repeated up to 500 times and the adjusted P value is the fraction of replications that produced a P value for some haplotype tested that is lower than or equal to the P value we observed using the original patient and control cohorts.

Results

Table 38 shows the results of the first step of the linkage analysis; multipoint non-parametric LOD scores for a framework marker map on chromosome 12. A LOD score suggestive of linkage of 1.95 was found at marker D12S2081. This linkage peak was one of the highest peaks found for the earlier onset MI phenotype. Table 39 shows the results of the second step of the linkage analysis; multipoint non-parametric LOD scores for the families after adding 20 fine mapping markers to the candidate region. The inclusion of additional microsatellite markers increased the information on sharing by decent from 0.8 to 0.9, around the markers that gave the highest LOD scores. The lodscore in this locus increased to 2.01 and the peak marker was D12S348 at centimorgin distance 110.6. Thus the locus remained suggestive for linkage suggesting that a gene conferring risk for MI was within the 10 million bases defined by the width of the linkage peak.

One of the genes close to the peak marker at this linkage peak (that is, the marker with the highest sharing or lodscore) was LTA4H. Our previous genetic work with FLAP showed that the leukotriene biosynthetic pathway plays a major role in MI risk. Since LTA4H encodes a major member of the leukotriene biosynthetic pathway converting Leukotriene A to Leukotriene B, we chose to test it for association to MI in a case-control study using 894 MI patients and 462 population-based controls.

The genomic sequence of the LTA4H gene is set out as SEQ ID NO: 718. The sequence of the LTA4H mRNA is set out as SEQ ID NO: 719. The sequence of the LTA4H polypeptide is set out as SEQ ID NO: 720.

Table 40 shows SNPs that were found by sequencing the LTA4H gene. One of the SNPs, LTA4H_31334, is in the coding region. The polymorphism, A\G, does not change the amino acid sequence in the protein. The rest of the SNPs were outside the coding exons of LTA4H and were within introns or flanking regions of LTA4H.

Table 41 shows results from the initial haplotype association analysis using 894 MI patients and 462 controls that were typed with 3 microsatellite markers and 12 SNPs. The following markers show a significant association with MI in males: DG12S1664, SG12S16, SG12S17, SG12S18, SG12S21, SG12S22, SG12S23, SG12S24, SG12S25, SG12S26, DG12S1666, SG12S100, SG12S28, and SG12S144, with alleles 0, C, A, T, G, G, T, T, A, T, 0, and T, T, and A, respectively. The allelic frequency of a shorter version of this haplotype including markers DG12S1664, SG12S26, DG12S1666, and SG12S144, with alleles 0, T, 0, and A, respectively, is 51% in male MI patients and 43% in controls (carried by 76% of male patients and 67% of controls). Allelic frequency of this haplotype is higher, or 56%, in a subgroup of patients that have had more than one MI (see Table 39).

Table 42 shows the results of the haplotype association analysis using 1560 unrelated MI patients and 953 unrelated population controls. A haplotype comprised of the consecutive markers was highly significant in MI patients that had also had either stroke or peripheral arterial occlusive disease (PAOD) (P-value adjusted for multiple comparisons=0.007). The fact that the haplotypes shown in Table 42 are more significant in MI patients that have more than one clinically evident cardiovascular complication might indicate that the gene played a role in clinical activity or severity of the atherosclerotic disease. The significantly associated haplotype is comprised of the following consecutive markers; SG12S438, DG12S1664, SG12S16, SG12S21, SG12S23, SG12S25, SG12S26, DG12S1666, SG12S100, SG12S28, SG12S143, SG12S144, SG12S221, SG12S222, SG12S223, SG12S225, SG12S226, SG12S233, SG12S237, and DG12S1668 with alleles C, 0, C, G,T, A, T, 0, T, T, T, A, G, C, C, G, G, C, T, and 0. Also shown in Table 42 is a shorter version of the consecutive haplotype and a haplotype that shows a significant protection against MI involving more than one clinically evident cardiovascular complication.

In summary, it has been shown for the first time that genetic variants of LTA4H show significant association to MI. The results complement previous work showing that variants in FLAP are significantly associated with MI. In both cases the risk ratio is similar to or higher than the conventional and well-known risk factors for MI including smoking, hypercholesterolemia, hypertension and diabetes among others.

All embodiments of the invention in relation to FLAP genetic discoveries, including but not limited to genetic and protein materials, genetic testing materials and methods, and testing and therapy are also applicable in the context of LTA4H genetic discoveries, and are repeated here by reference. Agents that target any point in the leukotriene biosynthesis pathway are contemplated and expected to be useful in therapy or prophylaxis for subjects with any of the genetic predispositions identified herein. For example, FLAP inhibitors are specifically contemplated for therapy of subjects at risk due to a LTA4H genotype.

TABLE 38

The marker map for chromosome 12 and LOD scores in the first step of the linkage analysis.

| location | LOD | dhat | NPL | Zlr | Info | marker |
|---|---|---|---|---|---|---|
| 0 | 1.2574 | −0.4865 | −1.6783 | −2.4063 | 0.5456 | D12S352 |
| 3.083 | 1.7993 | −0.5525 | −2.1441 | −2.8786 | 0.6374 | D12S1608 |
| 3.554 | 1.8107 | −0.5494 | −2.1696 | −2.8877 | 0.6472 | D12S1656 |
| 6.566 | 1.8434 | −0.5493 | −2.2066 | −2.9136 | 0.6591 | D12S1626 |
| 7.956 | 1.8748 | −0.5527 | −2.2239 | −2.9383 | 0.6638 | D12S372 |
| 12.93 | 1.5997 | −0.4719 | −2.166 | −2.7142 | 0.7291 | D12S1725 |
| 13.761 | 1.6842 | −0.4859 | −2.2249 | −2.785 | 0.732 | D12S314 |
| 16.166 | 1.6989 | −0.5279 | −2.0948 | −2.7971 | 0.6467 | D12S374 |
| 24.078 | 1.0258 | −0.4043 | −1.5861 | −2.1734 | 0.6036 | D12S336 |
| 26.254 | 1.0166 | −0.3907 | −1.6163 | −2.1637 | 0.6338 | D12S1697 |
| 31.288 | 0.9373 | −0.3846 | −1.5323 | −2.0775 | 0.6 | D12S364 |
| 34.202 | 0.8469 | −0.3806 | −1.4006 | −1.9748 | 0.5518 | D12S1728 |
| 39.399 | 0.8692 | −0.4163 | −1.3441 | −2.0007 | 0.4871 | D12S1682 |
| 44.135 | 0.7789 | −0.3786 | −1.306 | −1.894 | 0.5121 | D12S1591 |
| 49.974 | 0.7977 | −0.3819 | −1.3162 | −1.9166 | 0.5166 | D12S1640 |
| 52.254 | 0.8638 | −0.3759 | −1.4437 | −1.9945 | 0.5749 | D12S1704 |
| 53.951 | 0.8005 | −0.3442 | −1.4441 | −1.92 | 0.6191 | D12S1681 |
| 55.792 | 0.4155 | −0.2301 | −1.0815 | −1.3833 | 0.6554 | D12S345 |
| 57.468 | 0.2695 | −0.1842 | −0.8653 | −1.114 | 0.6382 | D12S1668 |
| 61.09 | 0.6674 | −0.3134 | −1.2999 | −1.7531 | 0.6074 | D12S85 |
| 67.239 | 0.9722 | −0.3854 | −1.5762 | −2.116 | 0.6203 | D12S368 |
| 74.802 | 0.8922 | −0.3971 | −1.4186 | −2.027 | 0.5412 | D12S83 |
| 76.789 | 0.9969 | −0.4272 | −1.4897 | −2.1426 | 0.5351 | D12S329 |
| 84.363 | 0.0618 | −0.103 | −0.3514 | −0.5333 | 0.4367 | D12S313 |
| 92.292 | 0.0266 | 0.052 | 0.2826 | 0.3497 | 0.6444 | D12S326 |
| 96.995 | 0.2219 | 0.1438 | 0.8312 | 1.0108 | 0.6496 | D12S1708 |
| 102.426 | 1.0345 | 0.2707 | 2.0001 | 2.1827 | 0.7615 | D12S351 |
| 103.746 | 1.4296 | 0.3119 | 2.3732 | 2.5659 | 0.7625 | D12S95 |
| 109.914 | 1.9537 | 0.3537 | 2.8183 | 2.9995 | 0.7796 | D12S2081 |
| 112.689 | 1.4231 | 0.2984 | 2.4796 | 2.56 | 0.84 | D12S346 |
| 114.367 | 1.1079 | 0.2685 | 2.1563 | 2.2588 | 0.8307 | D12S1727 |
| 117.962 | 1.2498 | 0.2916 | 2.2133 | 2.3991 | 0.7773 | D12S78 |
| 123.398 | 0.2995 | 0.1592 | 1.012 | 1.1744 | 0.7055 | D12S1613 |
| 126.542 | 0.1457 | 0.1139 | 0.6968 | 0.819 | 0.6986 | D12S1583 |
| 132.981 | 0.0058 | 0.0232 | 0.1392 | 0.1631 | 0.7222 | D12S354 |
| 133.655 | 0.0011 | 0.0106 | 0.0607 | 0.0725 | 0.6962 | D12S369 |
| 133.964 | 0.0012 | 0.0107 | 0.0608 | 0.0728 | 0.6913 | D12S79 |
| 139.646 | 0.0742 | 0.0823 | 0.4953 | 0.5844 | 0.701 | D12S366 |
| 142.505 | 0.1383 | 0.1088 | 0.694 | 0.7979 | 0.7292 | D12S395 |
| 143.459 | 0.0732 | 0.0795 | 0.5072 | 0.5805 | 0.7417 | D12S2073 |
| 143.698 | 0.0886 | 0.0875 | 0.5572 | 0.6387 | 0.7369 | D12S1349 |
| 144.394 | 0.0604 | 0.0727 | 0.4591 | 0.5275 | 0.7376 | D12S378 |
| 148.306 | 0 | 0.0013 | 0.0084 | 0.0096 | 0.7673 | D12S1614 |
| 151.275 | 0.0125 | 0.0351 | 0.1985 | 0.2397 | 0.6764 | D12S324 |
| 155.308 | 0.3155 | 0.1758 | 0.9568 | 1.2054 | 0.6008 | D12S2075 |
| 156.144 | 0.2797 | 0.1706 | 0.8734 | 1.1348 | 0.5679 | D12S1675 |
| 158.207 | 0.3194 | 0.1834 | 0.9265 | 1.2128 | 0.5549 | D12S1679 |

TABLE 38-continued

The marker map for chromosome 12 and LOD scores in the first step of the linkage analysis.

| location | LOD | dhat | NPL | Zlr | Info | marker |
|---|---|---|---|---|---|---|
| 162.448 | 0.3706 | 0.1872 | 1.0567 | 1.3063 | 0.6156 | D12S1659 |
| 164.59 | 0.368 | 0.1876 | 1.0474 | 1.3019 | 0.6084 | D12S367 |
| 172.615 | 0.3231 | 0.1872 | 0.9214 | 1.2199 | 0.5371 | D12S1723 |
| 174.333 | 0.2827 | 0.1781 | 0.847 | 1.1411 | 0.5229 | D12S1638 |

TABLE 39

The marker map for chromosome 12 and LOD scores, in the second step of the linkage analysis.

| location | LOD | dhat | NPL | Zlr | Info | marker |
|---|---|---|---|---|---|---|
| 0 | 1.6956 | −0.6253 | −1.8379 | −2.7944 | 0.4963 | D12S352 |
| 3.758 | 2.024 | −0.6098 | −2.2287 | −3.053 | 0.6154 | D12S1608 |
| 4.239 | 2.0532 | −0.6089 | −2.262 | −3.0749 | 0.6257 | D12S1656 |
| 4.899 | 2.0351 | −0.6062 | −2.2476 | −3.0614 | 0.6244 | D12S100 |
| 4.949 | 2.0335 | −0.6059 | −2.2466 | −3.0601 | 0.6243 | D12S1694 |
| 5.825 | 1.9982 | −0.5969 | −2.2337 | −3.0335 | 0.6278 | D12S1615 |
| 7.41 | 1.895 | −0.5609 | −2.2259 | −2.9541 | 0.6556 | D12S1626 |
| 8.241 | 1.9046 | −0.5627 | −2.2255 | −2.9616 | 0.6556 | D12S372 |
| 9.071 | 1.8945 | −0.5659 | −2.197 | −2.9537 | 0.6463 | D12S835 |
| 9.239 | 1.8908 | −0.5659 | −2.1919 | −2.9509 | 0.6452 | D12S1050 |
| 9.628 | 1.8804 | −0.5648 | −2.1812 | −2.9427 | 0.6435 | D12S1652 |
| 13.786 | 1.6009 | −0.4751 | −2.1492 | −2.7152 | 0.7218 | D12S1725 |
| 14.624 | 1.596 | −0.4767 | −2.1379 | −2.7111 | 0.7157 | D12S314 |
| 15.679 | 1.7102 | −0.5249 | −2.1113 | −2.8064 | 0.6569 | D12S328 |
| 15.729 | 1.7111 | −0.5255 | −2.1102 | −2.8071 | 0.656 | D12S93 |
| 15.917 | 1.7113 | −0.5272 | −2.1062 | −2.8073 | 0.6527 | D12S99 |
| 16.495 | 1.6721 | −0.5331 | −2.0411 | −2.7749 | 0.6266 | D12S1673 |
| 16.684 | 1.6562 | −0.5339 | −2.0199 | −2.7617 | 0.6192 | D12S356 |
| 17.131 | 1.6124 | −0.5336 | −1.9702 | −2.725 | 0.6035 | D12S374 |
| 20.18 | 1.4787 | −0.5541 | −1.7482 | −2.6095 | 0.5214 | D12S1625 |
| 23.545 | 1.1182 | −0.4645 | −1.5402 | −2.2693 | 0.5229 | D12S397 |
| 24.869 | 0.9441 | −0.4038 | −1.4682 | −2.0852 | 0.5568 | D12S1695 |
| 24.979 | 0.9297 | −0.3985 | −1.4625 | −2.0692 | 0.5606 | D12S336 |
| 25.269 | 0.9337 | −0.399 | −1.4663 | −2.0736 | 0.5617 | D12S1674 |
| 25.559 | 0.9367 | −0.3992 | −1.4704 | −2.077 | 0.5632 | D12S1690 |
| 25.772 | 0.9384 | −0.3999 | −1.4735 | −2.0788 | 0.5648 | D12S1696 |
| 25.793 | 0.9385 | −0.3989 | −1.4738 | −2.0789 | 0.5649 | D12S77 |
| 26.767 | 0.9395 | −0.3946 | −1.4893 | −2.08 | 0.5758 | D12S827 |
| 27.155 | 0.937 | −0.3915 | −1.4961 | −2.0773 | 0.5821 | D12S1697 |
| 27.325 | 0.938 | −0.3939 | −1.4894 | −2.0784 | 0.5766 | D12S89 |
| 28.883 | 0.9248 | −0.4057 | −1.4313 | −2.0636 | 0.5411 | D12S391 |
| 30.851 | 0.8473 | −0.39 | −1.3665 | −1.9754 | 0.5299 | D12S1581 |
| 31.936 | 0.7765 | −0.3651 | −1.3345 | −1.891 | 0.5429 | D12S1580 |
| 32.188 | 0.7575 | −0.3576 | −1.3274 | −1.8677 | 0.5489 | D12S320 |
| 32.238 | 0.7536 | −0.356 | −1.326 | −1.863 | 0.5503 | D12S364 |
| 32.735 | 0.7445 | −0.3581 | −1.3038 | −1.8516 | 0.538 | D12S308 |
| 34.013 | 0.7073 | −0.3557 | −1.2478 | −1.8048 | 0.5172 | D12S2210 |
| 34.335 | 0.6949 | −0.3532 | −1.2338 | −1.7889 | 0.5143 | D12S1303 |
| 35.153 | 0.6582 | −0.3436 | −1.1984 | −1.741 | 0.5108 | D12S1728 |
| 36.074 | 0.693 | −0.3705 | −1.1841 | −1.7864 | 0.4727 | D12S1715 |
| 37.358 | 0.7161 | −0.3917 | −1.1671 | −1.816 | 0.4445 | D12S310 |
| 37.716 | 0.723 | −0.3955 | −1.1681 | −1.8247 | 0.4414 | D12S1669 |
| 39.199 | 0.7267 | −0.3952 | −1.1753 | −1.8294 | 0.4443 | D12S1650 |
| 40.35 | 0.7034 | −0.3777 | −1.1844 | −1.7998 | 0.4644 | D12S1682 |
| 45.086 | 0.6102 | −0.3149 | −1.1956 | −1.6764 | 0.5509 | D12S1591 |
| 46.757 | 0.645 | −0.3251 | −1.2237 | −1.7234 | 0.5509 | D12S1057 |
| 47.216 | 0.6504 | −0.3287 | −1.2219 | −1.7307 | 0.5449 | D12S1617 |
| 49.098 | 0.6565 | −0.332 | −1.2227 | −1.7387 | 0.5404 | D12S1596 |
| 50.007 | 0.6508 | −0.3269 | −1.2292 | −1.7312 | 0.5503 | D12S1034 |
| 50.925 | 0.6382 | −0.3169 | −1.2391 | −1.7144 | 0.5696 | D12S1640 |
| 53.204 | 0.7066 | −0.3153 | −1.3729 | −1.8039 | 0.6362 | D12S1704 |
| 53.205 | 0.7066 | −0.3153 | −1.373 | −1.8039 | 0.6362 | D12S1643 |
| 54.901 | 0.6809 | −0.2936 | −1.4087 | −1.7708 | 0.695 | D12S1681 |
| 55.526 | 0.5731 | −0.2654 | −1.301 | −1.6245 | 0.6994 | D12S1648 |
| 55.827 | 0.5217 | −0.2504 | −1.25 | −1.55 | 0.7065 | D12S61 |
| 56.499 | 0.4119 | −0.2146 | −1.1385 | −1.3772 | 0.737 | ATA73C05 |
| 56.549 | 0.4041 | −0.2119 | −1.1303 | −1.3641 | 0.7401 | D12S1621 |
| 56.793 | 0.3671 | −0.1986 | −1.0906 | −1.3002 | 0.7572 | D12S345 |
| 57.118 | 0.3602 | −0.1959 | −1.0835 | −1.288 | 0.7615 | D12S2080 |
| 58.072 | 0.3416 | −0.1881 | −1.0664 | −1.2542 | 0.7782 | D12S1048 |

TABLE 39-continued

The marker map for chromosome 12 and LOD scores, in the second step of the linkage analysis.

| location | LOD | dhat | NPL | Zlr | Info | marker |
|---|---|---|---|---|---|---|
| 58.469 | 0.3345 | −0.1849 | −1.0609 | −1.2411 | 0.7867 | D12S1668 |
| 59.057 | 0.3671 | −0.1944 | −1.1109 | −1.3002 | 0.7874 | D12S1589 |
| 59.716 | 0.4056 | −0.2045 | −1.1706 | −1.3667 | 0.7932 | D12S291 |
| 60.054 | 0.4612 | −0.221 | −1.2374 | −1.4573 | 0.7826 | D12S1301 |
| 61.826 | 0.7555 | −0.2833 | −1.6011 | −1.8652 | 0.8213 | D12S1713 |
| 62.09 | 0.7752 | −0.2879 | −1.6189 | −1.8894 | 0.819 | D12S85 |
| 63.701 | 0.8433 | −0.309 | −1.6549 | −1.9707 | 0.7867 | D12S1701 |
| 64.377 | 0.8374 | −0.3088 | −1.6463 | −1.9637 | 0.7819 | D12S2199 |
| 64.888 | 0.821 | −0.3047 | −1.6355 | −1.9445 | 0.785 | D12S1590 |
| 65.096 | 0.8096 | −0.3025 | −1.6239 | −1.9309 | 0.784 | D12S1627 |
| 65.665 | 0.8586 | −0.3194 | −1.6441 | −1.9884 | 0.756 | D12S1620 |
| 65.666 | 0.8587 | −0.3194 | −1.6441 | −1.9885 | 0.7561 | D12S1635 |
| 66.235 | 0.8957 | −0.3295 | −1.6678 | −2.031 | 0.7474 | D12S1633 |
| 66.236 | 0.8958 | −0.3295 | −1.6678 | −2.0311 | 0.7473 | D12S1629 |
| 66.838 | 0.9205 | −0.3325 | −1.6967 | −2.0589 | 0.7558 | D12S347 |
| 67.205 | 0.9208 | −0.3307 | −1.7028 | −2.0592 | 0.7633 | D12S1677 |
| 68.24 | 1.1611 | −0.3656 | −1.9527 | −2.3124 | 0.8101 | D12S368 |
| 68.854 | 1.1354 | −0.3678 | −1.9021 | −2.2867 | 0.7842 | D12S96 |
| 69.118 | 1.1237 | −0.3682 | −1.8815 | −2.2749 | 0.7746 | D12S398 |
| 70.315 | 1.0649 | −0.3662 | −1.7961 | −2.2145 | 0.7407 | D12S1604 |
| 70.523 | 1.0539 | −0.3653 | −1.7827 | −2.2031 | 0.7365 | D12S359 |
| 70.637 | 1.0579 | −0.3678 | −1.7787 | −2.2072 | 0.7304 | D12S1651 |
| 71.597 | 1.0794 | −0.3844 | −1.7459 | −2.2296 | 0.6917 | D12S1724 |
| 71.8 | 1.0813 | −0.3867 | −1.7392 | −2.2315 | 0.6859 | D12S1707 |
| 72.252 | 1.0822 | −0.3904 | −1.7247 | −2.2324 | 0.6753 | D12S2191 |
| 73.451 | 1.0636 | −0.3917 | −1.6882 | −2.2132 | 0.6601 | D12S1632 |
| 74.528 | 1.0229 | −0.3828 | −1.6582 | −2.1704 | 0.6601 | D12S90 |
| 74.775 | 1.0106 | −0.3795 | −1.6517 | −2.1573 | 0.6617 | D12S305 |
| 74.919 | 1.0029 | −0.3773 | −1.648 | −2.1491 | 0.6631 | D12S1298 |
| 75.69 | 0.9563 | −0.363 | −1.6289 | −2.0985 | 0.6753 | D12S1700 |
| 75.691 | 0.9562 | −0.3629 | −1.6288 | −2.0984 | 0.6756 | D12S1056 |
| 75.744 | 0.9527 | −0.3618 | −1.6276 | −2.0946 | 0.6767 | D12S1662 |
| 75.802 | 0.9487 | −0.3605 | −1.6262 | −2.0902 | 0.6779 | D12S83 |
| 75.803 | 0.9487 | −0.3605 | −1.6262 | −2.0902 | 0.6779 | D12S1655 |
| 76.339 | 0.9582 | −0.3657 | −1.6221 | −2.1006 | 0.6682 | D12S298 |
| 76.916 | 0.9668 | −0.3701 | −1.62 | −2.1101 | 0.6606 | D12S1726 |
| 77.789 | 0.9767 | −0.3743 | −1.621 | −2.1209 | 0.6546 | D12S329 |
| 80.622 | 0.7896 | −0.3801 | −1.2958 | −1.9068 | 0.5155 | D12S1649 |
| 83.513 | 0.4582 | −0.2911 | −0.9752 | −1.4527 | 0.4746 | D12S1601 |
| 84.007 | 0.3957 | −0.2648 | −0.9209 | −1.35 | 0.4851 | D12S1294 |
| 84.428 | 0.3441 | −0.2407 | −0.8746 | −1.2588 | 0.5003 | D12S1335 |
| 85.558 | 0.2207 | −0.1753 | −0.75 | −1.0081 | 0.573 | D12S313 |
| 86.414 | 0.2075 | −0.1672 | −0.7361 | −0.9775 | 0.5883 | D12S375 |
| 86.588 | 0.2051 | −0.1658 | −0.7331 | −0.9718 | 0.5905 | D12S1680 |
| 87.042 | 0.198 | −0.1615 | −0.7253 | −0.9549 | 0.5991 | D12S1693 |
| 88.586 | 0.1683 | −0.1407 | −0.7008 | −0.8803 | 0.6584 | D12S1040 |
| 89.237 | 0.1545 | −0.1303 | −0.6917 | −0.8436 | 0.6988 | D12S299 |
| 89.238 | 0.1545 | −0.1303 | −0.6917 | −0.8435 | 0.6987 | D12S92 |
| 89.781 | 0.143 | −0.1214 | −0.6848 | −0.8116 | 0.7399 | D12S1052 |
| 90.368 | 0.131 | −0.1118 | −0.6779 | −0.7767 | 0.7921 | D12S337 |
| 91.289 | 0.155 | −0.1175 | −0.7641 | −0.8449 | 0.8534 | D12S1660 |
| 91.913 | 0.087 | −0.0886 | −0.5648 | −0.6331 | 0.8225 | D12S1684 |
| 92.02 | 0.0761 | −0.0831 | −0.5262 | −0.5921 | 0.8142 | D12S350 |
| 93.288 | 0.0009 | −0.0089 | −0.0583 | −0.0652 | 0.8082 | D12S326 |
| 97.989 | 0.2109 | 0.123 | 0.9332 | 0.9855 | 0.8597 | D12S1297 |
| 97.99 | 0.2119 | 0.1234 | 0.9351 | 0.9879 | 0.8588 | D12S106 |
| 97.991 | 0.213 | 0.1237 | 0.9371 | 0.9903 | 0.8578 | D12S1708 |
| 99.524 | 0.6535 | 0.201 | 1.7426 | 1.7347 | 0.9295 | D12S1667 |
| 99.525 | 0.6535 | 0.201 | 1.7427 | 1.7348 | 0.9296 | D12S319 |
| 100.397 | 0.7234 | 0.208 | 1.8684 | 1.8252 | 0.9553 | D12S323 |
| 100.398 | 0.7235 | 0.208 | 1.8686 | 1.8253 | 0.955 | D12S88 |
| 100.399 | 0.7301 | 0.2091 | 1.8758 | 1.8336 | 0.9533 | D12S1719 |
| 100.519 | 0.7536 | 0.2127 | 1.9016 | 1.8629 | 0.947 | D12S1593 |
| 101.064 | 0.8567 | 0.2269 | 2.0196 | 1.9863 | 0.9341 | D12S853 |
| 101.841 | 0.9732 | 0.2384 | 2.1747 | 2.117 | 0.951 | D12S1710 |
| 102.131 | 1.1754 | 0.2589 | 2.4086 | 2.3266 | 0.9561 | D12S1717 |
| 103.423 | 1.1442 | 0.2555 | 2.379 | 2.2955 | 0.9588 | D12S351 |
| 104.343 | 1.341 | 0.2756 | 0.5694 | 2.485 | 0.9479 | D12S311 |
| 104.743 | 1.6769 | 0.3035 | 2.8993 | 2.7789 | 0.952 | D12S95 |
| 105.266 | 1.7384 | 0.3095 | 2.9441 | 2.8294 | 0.9441 | D12S1345 |
| 106.345 | 1.8647 | 0.326 | 2.9793 | 2.9304 | 0.8988 | D12S1346 |
| 110.627 | 2.0063 | 0.3408 | 3.0437 | 3.0397 | 0.8726 | D12S348 |
| 110.908 | 1.9856 | 0.337 | 3.0533 | 3.0239 | 0.8861 | D12S1716 |
| 110.909 | 1.9854 | 0.337 | 3.053 | 3.0238 | 0.886 | D12S1657 |
| 112.477 | 1.3244 | 0.2754 | 2.5394 | 2.4696 | 0.9375 | D12S393 |
| 112.658 | 1.5716 | 0.2988 | 2.7576 | 2.6903 | 0.9246 | D12S1706 |
| 113.456 | 1.482 | 0.2868 | 2.7191 | 2.6125 | 0.9569 | D12S1600 |
| 113.686 | 1.4654 | 0.2856 | 2.7011 | 2.5978 | 0.9556 | D12S346 |
| 114.583 | 1.2538 | 0.2643 | 2.5203 | 2.4029 | 0.9739 | D12S1641 |
| 114.628 | 1.2491 | 0.2637 | 2.5166 | 2.3984 | 0.9748 | D12S306 |
| 114.674 | 1.2445 | 0.2632 | 2.5127 | 2.3939 | 0.9759 | D12S332 |
| 115.043 | 1.3131 | 0.271 | 2.5676 | 2.4591 | 0.9635 | D12S1041 |
| 115.364 | 1.1318 | 0.2546 | 2.3621 | 2.283 | 0.956 | D12S1727 |
| 116.299 | 1.1829 | 0.2606 | 2.4032 | 2.334 | 0.9477 | D12S1607 |
| 116.948 | 1.2361 | 0.2691 | 2.4273 | 2.3859 | 0.9221 | IGF1 |
| 116.949 | 1.2361 | 0.2691 | 2.4273 | 2.3859 | 0.9219 | D12S1030 |
| 117.75 | 1.5059 | 0.2956 | 2.6701 | 2.6334 | 0.9082 | PAH |
| 118.61 | 1.2001 | 0.2629 | 2.4192 | 2.3509 | 0.9435 | D12S360 |
| 118.899 | 1.4558 | 0.2869 | 2.6729 | 2.5893 | 0.9393 | D12S78 |
| 119.188 | 1.399 | 0.2838 | 2.5969 | 2.5382 | 0.9253 | D12S338 |
| 120.067 | 1.3032 | 0.2727 | 2.5213 | 2.4498 | 0.943 | D12S1647 |
| 120.068 | 1.2993 | 0.2723 | 2.5179 | 2.4461 | 0.9436 | D12S317 |
| 120.348 | 1.4722 | 0.2886 | 2.6798 | 2.6038 | 0.9378 | D12S1597 |
| 121.195 | 1.3839 | 0.2842 | 2.5548 | 2.5245 | 0.9127 | D12S1683 |
| 124.023 | 0.6306 | 0.2003 | 1.693 | 1.7041 | 0.9045 | D12S1342 |
| 124.297 | 0.6069 | 0.198 | 1.6474 | 1.6718 | 0.8927 | D12S1613 |
| 125.597 | 0.483 | 0.183 | 1.4221 | 1.4915 | 0.8432 | D12S1605 |
| 126.055 | 0.451 | 0.1786 | 1.3612 | 1.4411 | 0.8293 | D12S84 |
| 126.796 | 0.3855 | 0.1683 | 1.2383 | 1.3324 | 0.8059 | D12S105 |
| 127.545 | 0.3132 | 0.1527 | 1.1129 | 1.2009 | 0.8072 | D12S1583 |
| 129.188 | 0.2211 | 0.1354 | 0.8864 | 1.009 | 0.7362 | D12S1344 |
| 130.64 | 0.141 | 0.1122 | 0.6858 | 0.8058 | 0.6977 | D12S1616 |
| 133.986 | 0.0109 | 0.0313 | 0.1941 | 0.2238 | 0.742 | D12S354 |
| 134.268 | 0.0114 | 0.0321 | 0.1973 | 0.2287 | 0.7353 | D12S1023 |
| 134.818 | 0.0122 | 0.0336 | 0.2027 | 0.237 | 0.7233 | D12S369 |
| 134.959 | 0.0122 | 0.0336 | 0.2019 | 0.2365 | 0.7205 | D12S1602 |
| 135.149 | 0.0121 | 0.0335 | 0.2006 | 0.2356 | 0.7164 | D12S79 |
| 135.367 | 0.0102 | 0.0312 | 0.1829 | 0.217 | 0.7035 | D12S1665 |
| 137.617 | 0.0008 | 0.0093 | 0.0498 | 0.0617 | 0.6492 | D12S1718 |
| 140.815 | 0.0287 | 0.0511 | 0.3109 | 0.3633 | 0.7212 | D12S366 |
| 141.527 | 0.0431 | 0.0638 | 0.374 | 0.4458 | 0.6902 | D12S349 |
| 141.528 | 0.0879 | 0.0897 | 0.5377 | 0.6361 | 0.6935 | D12S1619 |
| 141.755 | 0.0867 | 0.0892 | 0.5334 | 0.6317 | 0.6917 | D12S385 |
| 143.676 | 0.0629 | 0.073 | 0.476 | 0.5383 | 0.7618 | D12S395 |
| 143.677 | 0.0629 | 0.073 | 0.4759 | 0.5382 | 0.7615 | D12S321 |
| 143.678 | 0.0629 | 0.073 | 0.4759 | 0.5381 | 0.7613 | D12S1721 |
| 143.824 | 0.0588 | 0.0707 | 0.4601 | 0.5205 | 0.7614 | D12S1666 |
| 144.632 | 0.0428 | 0.0604 | 0.3929 | 0.444 | 0.7652 | D12S2073 |
| 144.962 | 0.0437 | 0.0611 | 0.3961 | 0.4485 | 0.7621 | D12S1349 |
| 145.291 | 0.037 | 0.0563 | 0.3644 | 0.4128 | 0.7628 | D12S1603 |
| 145.426 | 0.0331 | 0.0534 | 0.3446 | 0.3907 | 0.7623 | D12S378 |
| 149.447 | 0.0134 | −0.0352 | −0.2159 | −0.2483 | 0.7658 | D12S1614 |
| 149.448 | 0.0134 | −0.0352 | −0.2158 | −0.2483 | 0.7656 | D12S342 |
| 152.517 | 0.0049 | −0.0224 | −0.124 | −0.1505 | 0.6847 | D12S324 |
| 153.404 | 0.0009 | −0.0099 | −0.0509 | −0.064 | 0.6328 | D12S1634 |
| 153.405 | 0.0009 | −0.0098 | −0.0507 | −0.0638 | 0.6382 | D12S307 |
| 154.88 | 0.0244 | 0.0534 | 0.2534 | 0.3353 | 0.561 | D12S1658 |
| 155.819 | 0.0768 | 0.0941 | 0.447 | 0.5948 | 0.549 | GATA41E12 |
| 155.94 | 0.0855 | 0.0991 | 0.472 | 0.6275 | 0.5489 | D12S2078 |
| 157.397 | 0.0566 | 0.0832 | 0.3729 | 0.5104 | 0.5228 | D12S1675 |
| 159.342 | 0.0829 | 0.0973 | 0.4654 | 0.6179 | 0.5526 | D12S1679 |
| 161.157 | 0.1143 | 0.1111 | 0.5609 | 0.7255 | 0.5776 | D12S1609 |
| 163.425 | 0.1165 | 0.1067 | 0.5964 | 0.7324 | 0.6407 | D12S834 |
| 163.559 | 0.1167 | 0.1063 | 0.5993 | 0.733 | 0.6461 | D12S1659 |
| 165.72 | 0.175 | 0.1287 | 0.7383 | 0.8977 | 0.6479 | D12S1714 |
| 165.721 | 0.175 | 0.1287 | 0.7383 | 0.8978 | 0.648 | D12S367 |
| 168.245 | 0.1739 | 0.132 | 0.7137 | 0.8949 | 0.6107 | D12S2069 |
| 168.246 | 0.1739 | 0.132 | 0.7138 | 0.8949 | 0.6105 | D12S97 |
| 170.298 | 0.2145 | 0.1514 | 0.7627 | 0.9938 | 0.5626 | D12S343 |
| 170.824 | 0.2262 | 0.156 | 0.78 | 1.0207 | 0.5566 | D12S1599 |
| 171.817 | 0.2496 | 0.1638 | 0.8178 | 1.0722 | 0.5531 | D12S392 |
| 173.734 | 0.2978 | 0.1751 | 0.9099 | 1.171 | 0.5715 | D12S1723 |
| 175.333 | 0.2667 | 0.1709 | 0.8351 | 1.1083 | 0.5393 | D12S357 |
| 175.456 | 0.2648 | 0.1707 | 0.8307 | 1.1043 | 0.5372 | D12S1638 |
| 176.211 | 0.2665 | 0.1772 | 0.8027 | 1.1079 | 0.4984 | D12S2343 |

TABLE 40

| NCBI Build34 position | Marker name | Marker alias | IUPAC | Public SNP | Variation | Minor allele | Minor allele percentage |
|---|---|---|---|---|---|---|---|
| 94877218 | SG12S432 | | R | rs2270318 | A/G | A | 25.3 |
| 94877441 | | | indel | rs10708992 | —/A | | |
| 94878002 | | | R | rs7966537 | A/G | | |
| 94878095 | | | M | rs17024935 | A/C | C | 10.3 |
| 94878150 | | | Y | rs10859995 | C/T | C | 42.1 |
| 94878253 | | | R | rs17676451 | A/G | A | 9.9 |
| 94878559 | | | Y | rs17024937 | C/T | C | 1.4 |
| 94878727 | | | Y | rs17733203 | C/T | T | 8.6 |
| 94878752 | | | S | rs11108359 | C/G | | |
| 94879491 | | | R | rs11108360 | A/G | | |
| 94880727 | SG12S433 | | R | rs2300560 | A/G | A | 35.9 |
| 94880770 | | | S | rs7136523 | C/G | | |
| 94880966 | | | K | rs11108361 | G/T | | |
| 94881186 | | | Y | rs12298414 | C/T | | |
| 94881226 | | | M | rs7136852 | A/C | | |
| 94881239 | SG12S434 | | R | rs3819817 | A/G | A | 38 |
| 94881275 | | | Y | rs10859996 | C/T | | |
| 94881395 | | | Y | rs10492228 | C/T | T | 12.1 |
| 94881566 | | | K | rs11108362 | G/T | | |
| 94881734 | | | K | rs11108363 | G/T | | |
| 94882274 | SG12S435 | | Y | rs3213737 | C/T | T | 39.8 |
| 94882599 | | | Y | rs12301817 | C/T | | |
| 94883443 | | | R | rs11108364 | A/G | G | 12 |
| 94883700 | SG12S436 | | K | rs2072511 | G/T | T | 28.5 |
| 94883960 | | | Y | rs11108365 | C/T | | |
| 94884133 | | | W | rs2287057 | A/T | | |
| 94884140 | | | K | rs7304917 | G/T | | |
| 94884144 | | | S | rs2270317 | C/G | | |
| 94884167 | | | W | rs12814960 | A/T | | |
| 94884256 | | | M | rs4762262 | A/C | | |
| 94884722 | | | K | rs11108366 | G/T | T | 14.8 |
| 94884775 | SG12S437 | | R | rs2268520 | A/G | G | 25.3 |
| 94884783 | | | S | rs7308555 | C/G | | |
| 94885068 | | | S | rs2268519 | C/G | G | 9.9 |
| 94885112 | | | R | rs7308827 | A/G | | |
| 94885134 | | | R | rs12319274 | A/G | | |
| 94885170 | | | R | rs2268518 | A/G | G | 34.5 |
| 94885285 | SG12S438 | | S | rs2268517 | C/G | G | 9.36 |
| 94885406 | | | Y | rs12307364 | C/T | | |
| 94885635 | | | S | rs11108367 | C/G | | |
| 94886499 | | | Y | rs10745747 | C/T | T | 18.2 |
| 94886568 | | | Y | rs7316786 | C/T | | |
| 94886813 | | | Y | rs17676826 | C/T | C | 25.4 |
| 94887010 | | | R | rs4762263 | A/G | | |
| 94887137 | | | S | rs12309712 | C/G | | |
| 94887170 | | | Y | rs2287056 | C/T | | |
| 94887310 | | | R | rs2287055 | A/G | | |
| 94887493 | | | indel | rs3214368 | —/A | | |
| 94887827 | | | Y | rs10859997 | C/T | | |
| 94887924 | | | R | rs10859998 | A/G | | |
| 94888002 | | | K | rs12318681 | G/T | | |
| 94888606 | | | R | rs11108368 | A/G | A | 44.3 |
| 94888625 | | | K | rs17024956 | G/T | G | 12.7 |
| 94888741 | | | Y | rs17024962 | C/T | T | 12.7 |
| 94889326 | | | Y | rs10492227 | C/T | T | 25.2 |
| 94889459 | SG12S439 | | S | rs2241137 | C/G | G | 25.9 |
| 94889540 | SG12S440 | | Y | rs2241136 | C/T | T | 18.9 |
| 94890077 | | | R | rs17024973 | A/G | A | 1.4 |
| 94890089 | | | Y | rs2302629 | C/T | T | 41.4 |
| 94890233 | | | W | rs2302628 | A/T | T | 37.1 |
| 94890297 | | | R | rs17677007 | A/G | G | 8.5 |
| 94890520 | | | R | rs17024981 | A/G | A | 9.9 |
| 94890551 | | | K | rs17024986 | G/T | G | 11.4 |
| 94890561 | | | R | rs4595631 | A/G | | |
| 94890567 | | | R | rs17024995 | A/G | A | 1.4 |
| 94890650 | | | M | rs3741815 | A/C | | |
| 94891571 | | | M | rs4762264 | A/C | | |
| 94891698 | | | Y | rs4325387 | C/T | | |
| 94892369 | | | K | rs11108369 | G/T | | |
| 94892620 | | | Y | rs7970524 | C/T | C | 12 |
| 94892804 | | | R | rs2070614 | A/G | G | 42.7 |
| 94892826 | | | M | rs7134860 | A/C | A | 7 |
| 94892888 | | | M | rs7134975 | A/C | A | 7.7 |
| 94892970 | | | Y | rs7306086 | C/T | | |
| 94893073 | | | R | rs7956014 | A/G | | |
| 94893802 | | | Y | rs10859999 | C/T | T | 48.6 |

TABLE 40-continued

| NCBI Build34 position | Marker name | Marker alias | IUPAC | Public SNP | Variation | Minor allele | Minor allele percentage |
|---|---|---|---|---|---|---|---|
| 94893822 | | | R | rs11108370 | A/G | | |
| 94893903 | | | Y | rs11108371 | C/T | | |
| 94894461 | | | Y | rs11835389 | C/T | | |
| 94894725 | | | Y | rs11837995 | C/T | | |
| 94895550 | | | Y | rs2367755 | C/T | | |
| 94895729 | | | R | rs12302993 | A/G | | |
| 94895964 | | | K | rs17025016 | G/T | T | 10 |
| 94896055 | SG12S16 | LTA4H_3645 | Y | NN | C/T | T | 22.64 |
| 94896115 | SG12S56 | LTA4H_3705 | K | NN | G/T | G | 4.14 |
| 94896261 | | | M | rs11614411 | A/C | | |
| 94896339 | SG12S57 | LTA4H_3929 | Y | NN | C/T | C | 2.5 |
| 94896351 | SG12S58 | LTA4H_3941 | S | NN | C/G | C | 0.85 |
| 94896393 | SG12S37 | LTA4H_3983 | W | NN | A/T | T | 9.3 |
| 94896548 | | | K | rs12298595 | G/T | | |
| 94896571 | | | Y | rs12318335 | C/T | | |
| 94896705 | SG12S59 | LTA4H_4295 | R | NN | A/G | A | 4.5 |
| 94896786 | SG12S60 | LTA4H_4376 | R | NN | A/G | A | 2.87 |
| 94896832 | SG12S61 | LTA4H_4422 | R | NN | A/G | G | 1.56 |
| 94896897 | SG12S29 | LTA4H_4487 | W | NN | A/T | T | 4.26 |
| 94896985 | SG12S17 | LTA4H_4575 | R | rs11108372 | A/G | A | 41.41 |
| 94897159 | | | M | rs1050970 | A/C | C | 3 |
| 94897272 | | | S | rs1803916 | C/G | | |
| 94897845 | SG12S62 | LTA4H_5435 | Y | NN | C/T | C | 1.17 |
| 94897991 | | | S | rs11108373 | C/G | | |
| 94898791 | | | R | rs17025023 | A/G | A | 6.3 |
| 94898807 | | | Y | rs12322336 | C/T | | |
| 94898878 | SG12S63 | LTA4H_6468 | Y | rs17025026 | C/T | T | 4.46 |
| 94898878 | SG12S63 | | Y | rs17025026 | C/T | T | 12.7 |
| 94899057 | SG12S64 | LTA4H_6647 | Y | NN | C/T | C | 2.99 |
| 94899549 | SG12S18 | LTA4H_7139 | W | rs17677343 | A/T | A | 21.72 |
| 94899839 | | | indel | rs11398806 | del/T | | |
| 94900318 | SG12S19 | LTA4H_7908 | indel | NN | indel | | |
| 94900320 | | | indel | rs11374431 | del/A | | |
| 94900639 | | | K | rs17025028 | G/T | G | 14.1 |
| 94900639 | SG12S65 | LTA4H_8229 | K | rs17677343 | G/T | G | 5.09 |
| 94900892 | SG12S66 | LTA4H_8482 | R | NN | A/G | G | 0.59 |
| 94901296 | SG12S542/SG12S540 | LTA4H_8886 | Y | rs2540500 | C/T | T | 33.1 |
| 94901997 | SG12S68 | LTA4H_9587 | indel | NN | indel | | |
| 94902004 | | | indel | rs5800240 | del/T | | |
| 94902169 | SG12S69 | LTA4H_9759 | W | NN | A/T | A | 0.88 |
| 94902337 | SG12S70 | LTA4H_9927 | M | rs2540499 | A/C | A | 24.09 |
| 94902454 | SG12S71 | LTA4H_10044 | Y | rs5020450 | C/T | C | 20.93 |
| 94902928 | SG12S72 | LTA4H_10518 | Y | rs17025033 | C/T | T | 1.35 |
| 94903037 | SG12S30 | LTA4H_10627 | W | rs2540498 | A/T | A | 22.36 |
| 94903300 | SG12S73 | LTA4H_10890 | Y | rs2300559 | C/T | C | 2.33 |
| 94903618 | SG12S20 | LTA4H_11208 | M | NN | A/C | C | 39.08 |
| 94903720 | SG12S21 | LTA4H_11310 | R | rs2660880 | A/G | A | 5.95 |
| 94903837 | | | R | rs2300558 | A/G | | |
| 94905002 | SG12S38 | LTA4H_12592 | Y | rs2110762 | C/T | C | 34.92 |
| 94905002 | | | R | rs2270316 | A/G | | |
| 94905210 | | | K | rs4462431 | G/T | | |
| 94905216 | SG12S74 | LTA4H_12806 | Y | NN | C/T | T | 0.8 |
| 94905667 | SG12S22 | LTA4H_13257 | R | rs2072510 | A/G | A | 36.88 |
| 94905821 | SG12S75 | LTA4H_13411 | Y | NN | C/T | T | 1.39 |
| 94906078 | SG12S23 | LTA4H_13668 | Y | rs6538697 | C/T | C | 7.06 |
| 94906362 | SG12S31 | LTA4H_13952 | Y | rs7296106 | C/T | T | 5.67 |
| 94906457 | SG12S76 | LTA4H_14047 | W | rs10492226 | A/T | A | 1.18 |
| 94906743 | SG12S77 | LTA4H_14333 | W | rs2540497 | A/T | A | 24.77 |
| 94907375 | SG12S78 | LTA4H_14965 | Y | NN | C/T | T | 2.48 |
| 94907545 | SG12S24 | LTA4H_15135 | Y | rs2660900 | C/T | C | 23.76 |
| 94907820 | | | R | rs17025050 | A/G | G | 3.5 |
| 94907935 | SG12S79 | LTA4H_15525 | S | NN | C/G | C | 0.83 |
| 94907970 | | | Y | rs12302496 | C/T | | |
| 94908408 | | | Y | rs17025054 | C/T | T | 1.4 |
| 94908971 | SG12S32 | LTA4H_16561 | R | rs2540496 | A/G | A | 31.11 |
| 94909012 | SG12S80 | LTA4H_16602 | W | NN | A/T | A | 0.74 |
| 94909191 | SG12S39 | LTA4H_16781 | K | rs2540495 | G/T | T | 30.74 |
| 94909463 | | | R | rs12306086 | A/G | | |
| 94909554 | SG12S81 | LTA4H_17144 | R | rs12319438 | A/G | G | 4.12 |
| 94910164 | SG12S82 | LTA4H_17754 | R | NN | A/G | A | 0.4 |
| 94910246 | SG12S83 | LTA4H_17836 | W | NN | A/T | T | 1.21 |
| 94910273 | SG12S84 | LTA4H_17863 | R | NN | A/G | A | 2.82 |
| 94910771 | | | S | rs11108374 | C/G | | |
| 94910810 | | | S | rs4397945 | C/G | | |
| 94911126 | | | Y | rs17403903 | C/T | | |
| 94911249 | | | Y | rs11108375 | C/T | T | 6.9 |

TABLE 40-continued

| NCBI Build34 position | Marker name | Marker alias | IUPAC | Public SNP | Variation | Minor allele | Minor allele percentage |
|---|---|---|---|---|---|---|---|
| 94911444 | SG12S543 | | W | rs2072512 | A/T | A | 45.2 |
| 94911540 | | | Y | rs11108376 | C/T | | |
| 94911669 | SG12S25 | LTA4H_19259 | R | rs1978331 | A/G | G | 31.68 |
| 94911781 | SG12S85 | LTA4H_19371 | Y | NN | C/T | T | 1.25 |
| 94912503 | | | Y | rs11108377 | C/T | | |
| 94913865 | | | R | rs12049939 | A/G | | |
| 94914296 | SG12S40 | LTA4H_21886 | W | rs7959337 | A/T | A | 5.29 |
| 94914806 | | | K | rs2540494 | G/T | | |
| 94915536 | | | N | rs12721569 | A/C/G/T | A | 3.5 |
| 94915637 | | | Y | rs12721570 | C/T | T | 1.7 |
| 94916236 | SG12S86 | LTA4H_23826 | R | NN | A/G | G | 4.71 |
| 94916322 | | | Y | rs11108378 | C/T | | |
| 94916445 | SG12S87 | LTA4H_24035 | Y | NN | C/T | T | 1.27 |
| 94916452 | SG12S88 | LTA4H_24042 | R | rs1990611 | A/G | A | 33.76 |
| 94916805 | SG12S89 | LTA4H_24395 | R | rs7981011 | A/G | G | 4.91 |
| 94916919 | SG12S26 | LTA4H_24509 | Y | rs17677715 | C/T | C | 17.16 |
| 94917444 | SG12S90 | LTA4H_25034 | R | rs17025074 | A/G | A | 0.84 |
| 94918310 | | | K | rs2540493 | G/T | | |
| 94918356 | | | R | rs11108379 | A/G | | |
| 94918851 | SG12S91 | LTA4H_26441 | Y | rs2660838 | C/T | C | 25 |
| 94919176 | SG12S92 | LTA4H_26766 | Y | rs17677763 | C/T | C | 20.44 |
| 94919568 | | | indel | rs3831819 | —/TA | | |
| 94919667 | SG12S93 | LTA4H_27257 | R | rs2268516 | A/G | A | 2.44 |
| 94920127 | | | R | rs2540492 | A/G | G | 47.4 |
| 94920368 | SG12S94 | LTA4H_27958 | Y | rs2660839 | C/T | C | 31.82 |
| 94920656 | | | Y | rs11108380 | C/T | | |
| 94920916 | | | indel | rs5800241 | —/T | | |
| 94920977 | | | R | rs2540491 | A/G | | |
| 94921393 | SG12S544 | | R | rs17025079 | A/G | A | 7.1 |
| 94921441 | | | M | rs7959838 | A/C | | |
| 94921763 | SG12S41 | LTA4H_29353 | Y | NN | C/T | C | 20.35 |
| 94921923 | SG12S95 | LTA4H_29513 | R | rs4441106 | A/G | G | 7.07 |
| 94922111 | | | Y | rs12299755 | C/T | | |
| 94922409 | SG12S96 | LTA4H_29999 | R | rs763875 | A/G | A | 5.92 |
| 94922502 | SG12S97 | LTA4H_30092 | Y | rs763876 | C/T | T | 2.1 |
| 94922681 | SG12S98 | LTA4H_30271 | Y | rs763874 | C/T | C | 32.42 |
| 94923339 | | | Y | rs12310175 | C/T | | |
| 94923421 | | | Y | rs17025090 | C/T | C | 15.2 |
| 94923446 | SG12S42 | LTA4H_31036 | Y | rs2660892 | C/T | C | 27.41 |
| 94923710 | | | Y | rs12721566 | C/T | T | 9.3 |
| 94923744 | SG12S55 | LTA4H_31334 | R | NN | A/G | A | 0.27 |
| 94923759 | | | Y | rs11556465 | C/T | | |
| 94924037 | SG12S99 | LTA4H_31627 | R | NN | A/G | A | 4.37 |
| 94924389 | | | Y | rs2660893 | C/T | | |
| 94924541 | | | Y | rs2660894 | C/T | | |
| 94924845 | SG12S100 | LTA4H_32435 | Y | rs2247570 | C/T | C | 27.79 |
| 94924938 | SG12S101 | LTA4H_32528 | R | NN | A/G | A | 1.5 |
| 94925485 | | | R | rs12721568 | A/G | A | 3.5 |
| 94925915 | SG12S33 | LTA4H_33505 | Y | rs2660895 | C/T | C | 30.71 |
| 94925979 | | | R | rs11611612 | A/G | | |
| 94926097 | | | S | rs7312303 | C/G | | |
| 94926250 | | | Y | rs2660896 | C/T | | |
| 94926316 | | | Y | rs12308731 | C/T | | |
| 94926590 | SG12S34 | LTA4H_34180 | Y | rs2247330 | C/T | C | 30.9 |
| 94926724 | SG12S102 | LTA4H_34314 | R | rs2247323 | A/G | G | 31.85 |
| 94926915 | SG12S103 | LTA4H_34505 | Y | rs2247313 | C/T | T | 32.74 |
| 94927010 | SG12S104 | LTA4H_34600 | Y | rs2247309 | C/T | C | 32.74 |
| 94927133 | SG12S27 | LTA4H_34723 | Y | rs2247304 | C/T | C | 25.57 |
| 94927140 | | | M | rs12831920 | A/C | | |
| 94927693 | | | M | rs7134753 | A/C | | |
| 94927696 | | | W | rs7134754 | A/T | | |
| 94927900 | SG12S35 | LTA4H_35490 | R | rs2660897 | A/G | A | 35.93 |
| 94927959 | SG12S105 | LTA4H_35549 | Y | rs11108381 | C/T | T | 2.4 |
| 94928171 | | | Y | rs7956370 | C/T | T | 9.2 |
| 94928465 | SG12S28 | LTA4H_36055 | K | rs2660898 | G/T | G | 29.36 |
| 94928740 | SG12S36 | LTA4H_36330 | Y | rs2540490 | C/T | T | 31 |
| 94928970 | SG12S106 | LTA4H_36560 | Y | rs2540489 | C/T | C | 30.89 |
| 94929183 | SG12S107 | LTA4H_36773 | Y | rs11108382 | C/T | T | 2.58 |
| 94929213 | SG12S108 | LTA4H_36803 | R | rs2540488 | A/G | A | 26.28 |
| 94929669 | | | Y | rs17025102 | C/T | T | 2.1 |
| 94929761 | SG12S109 | LTA4H_37351 | Y | rs2300557 | C/T | T | 4.76 |
| 94929770 | SG12S110 | LTA4H_37360 | W | rs2246990 | A/T | A | 28.57 |
| 94929936 | SG12S111 | LTA4H_37526 | W | rs2300556 | A/T | A | 2.81 |
| 94930044 | SG12S112 | LTA4H_37634 | M | NN | A/C | C | 46.15 |
| 94930160 | | | M | rs7298811 | A/C | A | 8.5 |
| 94930343 | SG12S43 | LTA4H_37933 | K | rs2246973 | G/T | G | 32.93 |

TABLE 40-continued

| NCBI Build34 position | Marker name | Marker alias | IUPAC | Public SNP | Variation | Minor allele | Minor allele percentage |
|---|---|---|---|---|---|---|---|
| 94930357 | SG12S113 | LTA4H_37947 | Y | rs2246972 | C/T | T | 33.54 |
| 94931246 | SG12S114 | LTA4H_38836 | K | NN | G/T | T | 7.55 |
| 94931694 | | | K | rs11556466 | G/T | T | 3.33 |
| 94931694 | | | K | rs2228060 | G/T | T | 2.9 |
| 94931845 | | | Y | rs17525495 | C/T | T | 22 |
| 94931906 | | | indel | rs17525488 | del/A | \- | 20.6 |
| 94932251 | | | R | rs2540487 | A/G | | |
| 94932325 | | | Y | rs7304178 | C/T | | |
| 94932351 | | | Y | rs11108383 | C/T | | |
| 94932358 | | | indel | rs3834483 | —/A | | |
| 94932888 | | | K | rs2660899 | G/T | T | 30.1 |
| 94933142 | | | K | rs11108384 | G/T | | |
| 94933194 | | | S | rs10777767 | C/G | | |
| 94933475 | | | S | rs2540486 | C/G | | |
| 94933547 | | | R | rs11108385 | A/G | | |
| 94933939 | | | R | rs2660891 | A/G | | |
| 94934007 | | | indel | rs3834482 | —/CCG | | |
| 94934011 | | | S | rs12581112 | C/G | | |
| 94934104 | | | M | rs3759215 | A/C | | |
| 94934775 | SG12S141 | | R | rs10777768 | A/G | | |
| 94934975 | SG12S140 | | M | rs2660840 | A/C | C | 29.77 |
| 94935547 | | | W | rs7966262 | A/T | T | 29.7 |
| 94935843 | | | S | rs2540485 | C/G | | |
| 94935890 | | | R | rs17025122 | A/G | A | 12.7 |
| 94936032 | | | Y | rs2540484 | C/T | | |
| 94936244 | | | Y | rs2160250 | C/T | | |
| 94936596 | | | R | rs2540483 | A/G | | |
| 94936894 | | | Y | rs2160249 | C/T | | |
| 94936993 | | | Y | rs2110761 | C/T | | |
| 94937017 | | | Y | rs2110760 | C/T | | |
| 94937070 | | | Y | rs2110759 | C/T | | |
| 94937214 | | | R | rs7971150 | A/G | | |
| 94937296 | SG12S142 | | R | rs17025123 | A/G | G | 9.2 |
| 94937348 | SG12S143 | | Y | rs2540482 | C/T | C | 17.02 |
| 94937435 | | | S | rs2540481 | C/G | | |
| 94937520 | | | Y | rs2540480 | C/T | | |
| 94937707 | | | R | rs2540479 | A/G | | |
| 94937911 | | | R | rs2887104 | A/G | | |
| 94937970 | | | M | rs11108386 | A/C | | |
| 94938012 | | | Y | rs11830502 | C/T | | |
| 94938018 | | | R | rs11108387 | A/G | | |
| 94938027 | | | R | rs2367870 | A/G | | |
| 94938134 | | | R | rs2367871 | A/G | | |
| 94938212 | | | R | rs10735339 | A/G | | |
| 94938212 | | | Y | rs2540478 | C/T | | |
| 94938223 | | | K | rs10860000 | G/T | | |
| 94938459 | | | R | rs11615837 | A/G | | |
| 94939121 | | | Y | rs7314867 | C/T | T | 17 |
| 94939817 | | | R | rs10777769 | A/G | | |
| 94940022 | | | Y | rs2540477 | C/T | | |
| 94940156 | | | R | rs7954740 | A/G | | |
| 94940254 | | | Y | rs2660841 | C/T | | |
| 94940371 | | | W | rs2660842 | A/T | | |
| 94940394 | | | R | rs2660843 | A/G | | |
| 94940429 | | | Y | rs2367872 | C/T | | |
| 94940787 | | | M | rs2660844 | A/C | | |
| 94941021 | SG12S144 | | R | rs2660845 | A/G | G | 19.43 |
| 94941109 | | | K | rs7966098 | G/T | | |
| 94941218 | | | indel | rs11318627 | del/G | | |
| 94941392 | | | K | rs11608655 | G/T | | |
| 94941458 | | | R | rs10735340 | A/G | G | 40.8 |
| 94941488 | | | R | rs2660846 | A/G | | |
| 94941741 | | | R | rs11108388 | A/G | | |
| 94942862 | | | Y | rs2660847 | C/T | | |
| 94942863 | | | Y | rs2540476 | C/T | | |
| 94943081 | | | M | rs2660848 | A/C | | |
| 94943193 | | | Y | rs2660849 | C/T | | |
| 94943673 | | | R | rs12424449 | A/G | | |
| 94943761 | SG12S221 | | R | rs2540475 | A/G | A | 16.92 |
| 94944345 | | | Y | rs10860001 | C/T | T | 19.1 |
| 94945277 | | | Y | rs11108389 | C/T | | |
| 94946089 | SG12S222 | | Y | rs2660850 | C/T | C | 15.47 |
| 94946133 | | | R | rs12298458 | A/G | | |
| 94946358 | | | K | rs12823598 | G/T | | |
| 94946381 | | | K | rs12823759 | G/T | | |
| 94946826 | | | R | rs12822954 | A/G | | |

TABLE 40-continued

| NCBI Build34 position | Marker name | Marker alias | IUPAC | Public SNP | Variation | Minor allele | Minor allele percentage |
|---|---|---|---|---|---|---|---|
| 94947165 | | | K | rs2660851 | G/T | | |
| 94947830 | | | Y | rs11108390 | C/T | | |
| 94948016 | SG12S460 | | M | rs2660852 | A/C | A | 37.22 |
| 94948279 | | | R | rs1002070 | A/G | A | 11.7 |
| 94948684 | | | M | rs12579486 | A/C | | |
| 94949013 | | | S | rs1123456 | C/G | | |
| 94949092 | | | Y | rs12580856 | C/T | | |
| 94949200 | | | Y | rs11108391 | C/T | | |
| 94949965 | SG12S223 | | Y | rs2660875 | C/T | C | 43.79 |
| 94950315 | | | Y | rs2540474 | C/T | | |
| 94950568 | SG12S224 | | R | rs2540473 | A/G | G | 6.12 |
| 94951292 | | | Y | rs11108392 | C/T | | |
| 94951298 | | | Y | rs12820161 | C/T | | |
| 94951925 | | | M | rs10745748 | A/C | | |
| 94951964 | | | R | rs12425482 | A/G | G | 46.5 |
| 94952099 | | | S | rs10745749 | C/G | | |
| 94952099 | | | S | rs9737905 | C/G | | |
| 94952116 | | | K | rs10745750 | G/T | | |
| 94952116 | | | K | rs9738545 | G/T | | |
| 94952155 | | | R | rs7294638 | A/G | | |
| 94952158 | | | Y | rs7310911 | C/T | | |
| 94952847 | SG12S225 | | R | rs2540472 | A/G | A | 5.63 |
| 94953483 | SG12S226 | | S | rs2540471 | C/G | C | 37.7 |
| 94953648 | | | K | rs7302955 | G/T | | |
| 94953798 | SG12S227 | | R | rs17735342 | A/G | G | 12.5 |
| 94953801 | SG12S228 | | Y | rs2660890 | C/T | T | 46.96 |
| 94953831 | SG12S229 | | M | rs2660889 | A/C | | |
| 94953967 | | | R | rs28374901 | A/G | | |
| 94954155 | SG12S230 | | R | rs2660888 | A/G | A | 35.68 |
| 94954449 | SG12S231 | | Y | rs4762661 | C/T | | |
| 94955089 | | | R | rs7307954 | A/G | | |
| 94955162 | | | R | rs12305408 | A/G | | |
| 94955164 | | | R | rs12305409 | A/G | | |
| 94955310 | | | K | rs2540470 | G/T | | |
| 94955354 | | | R | rs2660887 | A/G | | |
| 94955396 | | | Y | rs12368890 | C/T | | |
| 94955578 | | | indel | rs11463945 | del/T | | |
| 94955864 | | | M | rs17025133 | A/C | A | 11.3 |
| 94956808 | | | R | rs11612148 | A/G | | |
| 94957324 | | | R | rs2540469 | A/G | | |
| 94957363 | | | Y | rs2660886 | C/T | | |
| 94957486 | | | S | rs2540468 | C/G | | |
| 94958156 | SG12S232 | | Y | NN | C/T | | |
| 94958339 | SG12S233 | | Y | rs2660885 | C/T | T | 15.18 |
| 94959833 | | | M | rs11108393 | A/C | | |
| 94960744 | | | R | rs4762662 | A/G | | |
| 94960854 | | | R | rs4762663 | A/G | | |
| 94961810 | | | K | rs759394 | G/T | T | 36.9 |
| 94962279 | | | S | rs759393 | C/G | | |
| 94962304 | | | R | rs759392 | A/G | | |
| 94962320 | | | R | rs734592 | A/G | | |
| 94962388 | SG12S234 | | R | rs5800242 | A/G | | |
| 94962388 | | | indel | rs5800242 | —/G | | |
| 94962435 | SG12S235 | | Y | rs759391 | C/T | | |
| 94962614 | | | R | rs17025149 | A/G | G | 10.6 |
| 94963320 | SG12S236 | | S | rs2540467 | C/G | | |
| 94963655 | SG12S237 | | Y | rs2540466 | C/T | T | 37.05 |
| 94963774 | SG12S238 | | Y | rs10492225 | C/T | C | 10.6 |
| 94964298 | SG12S239 | | W | rs2660874 | A/T | | |
| 94964443 | | | R | rs2660873 | A/G | | |
| 94964573 | | | M | rs2540465 | A/C | | |
| 94964776 | | | Y | rs12370699 | C/T | | |
| 94964783 | | | W | rs28593423 | A/T | | |
| 94965433 | | | R | rs2540464 | A/G | A | 37.8 |
| 94965472 | | | Y | rs2052257 | C/T | C | 29.5 |
| 94965687 | | | Y | rs12581811 | C/T | | |
| 94965875 | | | W | rs11108394 | A/T | | |
| 94966090 | | | Y | rs2540463 | C/T | | |
| 94966142 | | | Y | rs7301759 | C/T | | |
| 94966155 | | | indel | rs10564012 | —/TT | | |
| 94966160 | | | indel | rs10583879 | —/TT | | |
| 94966184 | | | indel | rs10564013 | —/AC | | |
| 94966209 | | | indel | rs10680979 | —/ACAC | | |
| 94966242 | | | K | rs2540462 | G/T | | |
| 94966584 | SG12S240 | | W | rs2540461 | A/T | A | 24.1 |

TABLE 40-continued

| NCBI Build34 position | Marker name | Marker alias | IUPAC | Public SNP | Variation | Minor allele | Minor allele percentage |
|---|---|---|---|---|---|---|---|
| 94948279 | | | R | rs1002070 | A/G | | |
| 94897159 | | | M | rs1050970 | A/C | | |

TABLE 41A

Haplotype association analysis including SNPs and microsatellite markers across the LTA4H gene.

| | DG 12S1664 | SG 12S16 | SG 12S17 | SG 12S18 | SG 12S21 | SG 12S22 | SG 12S23 | SG 12S24 | SG 12S25 | SG 12S26 |
|---|---|---|---|---|---|---|---|---|---|---|
| All MI vs controls | | | | | | | | | | |
| | 0 | C | A | T | G | G | T | T | A | T |
| short form | 0 | | | | | | | | | T |
| MI males vs controls | | | | | | | | | | |
| | 0 | C | A | T | G | G | T | T | A | T |
| short form | 0 | | | | | | | | | T |
| MI females vs controls | | | | | | | | | | |
| | 0 | C | A | T | G | G | T | T | A | T |
| short form | 0 | | | | | | | | | T |
| Recurrent MI vs controls | | | | | | | | | | |
| | 0 | C | A | T | G | G | T | T | A | T |
| short form | 0 | | | | | | | | | T |

| | DG 12S1666 | SG 12S100 | SG 12S28 | SG 12S144 | p-val | r | # aff | aff. frq. | # con | con. frq. |
|---|---|---|---|---|---|---|---|---|---|---|
| All MI vs controls | | | | | | | | | | |
| | 0 | T | T | A | 1.67E-02 | 1.24 | 590 | 0.49 | 481 | 0.44 |
| short form | 0 | | | A | 3.20E-03 | 1.32 | 590 | 0.5 | 480 | 0.43 |
| MI males vs controls | | | | | | | | | | |
| | 0 | T | T | A | 5.10E-03 | 1.34 | 361 | 0.51 | 481 | 0.44 |
| short form | 0 | | | A | 1.50E-03 | 1.4 | 361 | 0.51 | 480 | 0.43 |
| MI females vs controls | | | | | | | | | | |
| | 0 | T | T | A | 3.80E-01 | 1.11 | 229 | 0.46 | 481 | 0.44 |
| short form | 0 | | | A | 1.35E-01 | 1.2 | 229 | 0.47 | 480 | 0.43 |
| Recurrent MI vs controls | | | | | | | | | | |
| | 0 | T | T | A | 1.50E-02 | 1.51 | 88 | 0.54 | 481 | 0.44 |
| short form | 0 | | | A | 2.40E-03 | 1.69 | 88 | 0.56 | 480 | 0.43 |

TABLE 41B

Information on microsatellite markers that were used in the haplotype association analysis shown in Table 41A.

| Marker Name | DG12S1664 | DG12S1666 | DG12S1668 |
|---|---|---|---|
| Chr | 12 | 12 | 12 |
| Cytoband | q23.1 | q23.1 | q23.1 |

TABLE 41B-continued

Information on microsatellite markers that were used in the haplotype association analysis shown in Table 41A.

| Marker Name | DG12S1664 | DG12S1666 | DG12S1668 |
|---|---|---|---|
| Start in SEQ_ID_NO_718 (bp) | 7855 | 38342 | 86595 |
| NCBI_build33Start (Mb) | 96.317853 | 96.34834 | 96.396593 |
| Size | 238 | 188 | 398 |
| CEPH standard (reference allele) | 245 | 193 | 398 |
| Polymorphism type | SNP | Microsatellite | Microsatellite |
| Polymorphism class | in-del | Di | Di |
| Heterozygosity ratio | 0.23 | 0.52 | 0.72 |
| Forward primer | GGAAGGAGGACACTTCTGGA (SEQ ID NO: 721) | CACAGAAGCTGCAGTGGAAG (SEQ ID NO: 723) | GCAGTTTAAGCTGTATGTATATGAGG (SEQ ID NO: 725) |
| Reverse primer | GCTGTGAATGGCTAAACTTGG (SEQ ID NO: 722) | CAAATGGAGGAGTCAAGACCA (SEQ ID NO: 724) | TGAAAGCCATCACTGTAAGGA (SEQ ID NO: 726) |

TABLE 42

Haplotype association analysis including SNPs and microsatellite markers in the LTA4H gene region.

| | SG 12S438 | DG 12S1664 | SG 12S16 | SG 12S21 | SG 12S23 | SG 12S25 | SG 12S26 | DG 12S1666 | SG 12S100 | SG 12S28 | SG 12S143 | SG 12S144 | SG 12S221 |
|---|---|---|---|---|---|---|---|---|---|---|---|---|---|
| All MI vs controls | | | | | | | | | | | | | |
| Consecutive | C | 0 | C | G | T | A | T | 0 | T | T | T | A | G |
| Short version | C | 0 | | | | | | | | | | | |
| Protective variant | C | | C | | | | T | | | | T | | |
| MI males vs controls | | | | | | | | | | | | | |
| Consecutive | C | 0 | C | G | T | A | T | 0 | T | T | T | A | G |
| Short version | C | 0 | | | | | | | | | | | |
| Protective variant | C | | C | | | | T | | | | T | | |
| MI females vs controls | | | | | | | | | | | | | |
| Consecutive | C | 0 | C | G | T | A | T | 0 | T | T | T | A | G |
| Short version | C | 0 | | | | | | | | | | | |
| Protective variant | C | | C | | | | T | | | | T | | |
| Recurrent MI vs controls | | | | | | | | | | | | | |
| Consecutive | C | 0 | C | G | T | A | T | 0 | T | T | T | A | G |
| Short version | C | 0 | | | | | | | | | | | |
| Protective variant | C | | C | | | | T | | | | T | | |
| MI plus stroke or PAOD vs controls | | | | | | | | | | | | | |
| Consecutive | C | 0 | C | G | T | A | T | 0 | T | T | T | A | G |
| Short version | C | 0 | | | | | | | | | | | |
| Protective variant | C | | C | | | | T | | | | T | | |

| | SG 12S222 | SG 12S223 | SG 12S225 | SG 12S226 | SG 12S233 | SG 12S237 | DG 12S1668 | p-val | P-val adj. | r | # aff | aff frq. | # con | con. frq. |
|---|---|---|---|---|---|---|---|---|---|---|---|---|---|---|
| All MI vs controls | | | | | | | | | | | | | | |
| Consecutive | C | C | G | G | C | T | 0 | 6.2E-02 | | 1.34 | 1560 | 0.051 | 953 | 0.039 |
| Short version | | C | | G | | | 0 | 1.5E-03 | | 1.63 | 1556 | 0.071 | 951 | 0.045 |
| Protective variant | | | | | | | C | 7.5E-02 | | 0.88 | 1557 | 0.290 | 951 | 0.317 |

TABLE 42-continued

Haplotype association analysis including SNPs and microsatellite markers in the LTA4H gene region.

| | | | | | | | | P-val | P-val adj | r | #aff | Aff.frq | #con | Con.frq |
|---|---|---|---|---|---|---|---|---|---|---|---|---|---|---|
| MI males vs controls | | | | | | | | | | | | | | |
| Consecutive | C | C | G | G | C | T | 0 | 2.2E-02 | | 1.49 | 1096 | 0.051 | 953 | 0.035 |
| Short version | C | | | G | | | 0 | 3.1E-03 | | 1.66 | 1093 | 0.069 | 951 | 0.043 |
| Protective variant | | | | | | C | | 6.3E-02 | | 0.86 | 1094 | 0.283 | 951 | 0.314 |
| MI females vs controls | | | | | | | | | | | | | | |
| Consecutive | C | C | G | G | C | T | 0 | 4.3E-01 | | 1.19 | 464 | 0.046 | 953 | 0.039 |
| Short version | C | | | G | | | 0 | 1.6E-02 | | 1.60 | 463 | 0.073 | 951 | 0.047 |
| Protective variant | | | | | | C | | 3.1E-01 | | 0.91 | 463 | 0.301 | 951 | 0.322 |
| Recurrent MI vs controls | | | | | | | | | | | | | | |
| Consecutive | C | C | G | G | C | T | 0 | 7.7E-02 | | 1.52 | 273 | 0.060 | 953 | 0.040 |
| Short version | C | | | G | | | 0 | 7.5E-02 | | 1.54 | 272 | 0.067 | 951 | 0.045 |
| Protective variant | | | | | | C | | 9.8E-02 | | 0.82 | 273 | 0.274 | 951 | 0.316 |
| MI plus stroke or PAOD vs controls | | | | | | | | | | | | | | |
| Consecutive | C | C | G | G | C | T | 0 | 1.5E-03 | 0.007 | 1.97 | 325 | 0.073 | 953 | 0.038 |
| Short version | C | | | G | | | 0 | 2.4E-05 | 0.038 | 2.39 | 325 | 0.099 | 951 | 0.044 |
| Protective variant | | | | | | C | | 4.1E-05 | | 0.61 | 325 | 0.220 | 951 | 0.315 |

P-val = p-value.
P-val adj: P-value adjusted for multiple comparisons.
r = Relative risk.
aff = Number of patients.
con = number of controls.
Aff.frq = haplotype/allelic frequency in patients.
Con.frq = haplotype/allelic frequency in controls.

Discussion

In a genome wide search for susceptibility genes for MI, a gene was mapped to 12q23. This locus was fine mapped with microsatellite markers. Haplotype analysis in a large case-control association study using markers spanning a 79 kb region across the LTA4H gene, shows that LTA4H is a significant susceptibility gene for MI.

The LTA4H gene encodes a protein that is required for leukotriene B4 synthesis. The leukotrienes are potent inflammatory lipid mediators derived from arachidonic acid. Given that our data shows that LTA4H shows significant association to MI, it may contribute to development of atherosclerosis in coronary arteries and/or to the destabilization of existing coronary atherosclerotic plaques through lipid oxidation and/or proinflammatory effects.

Dashwood and coworkers have studied expression of the enzymes that control the formation of leukotrienes in coronary arteries. They showed that cells showing positive antibody binding to 5-LO, FLAP (5-lipoxygenase activating protein), and leukotriene A4 hydrolase were present in the coronary arteries and had a similar distribution to macrophages. (Dashwood, et al, Circulation June 1998 23;97(24): 2406-13). Thus, LTA4H and other members of the leukotriene pathway are expressed within cell types found in atherosclerotic lesions that form the basis for the final event of myocardial infarction. Their potential role in plaque instability may explain why many patients have stable angina for years without suffering a myocardial infarction (and therefore presumably have atherosclerotic lesions without the instability that leads to overriding thrombosis and MI) while others suffer MI with little or no period of stable angina. Those patients with elevated LTA4H enzymatic activity in atherosclerotic lesions may have more unstable plaques and higher MI rates. In addition, increased LTA4H activity may accelerate atherosclerosis lesion formation and progression.

This LTA4H data complements data presented above on the gene that encodes FLAP, which works with 5-LO to produce Leukotriene A4; that is, it is upstream of LTA4H. We found that variants in the FLAP gene more than double the risk of MI. LTA4H represents the second member of the leukotriene biosynthetic pathway that we have been the first to show confers substantially higher risk for MI.

Further work in animals which supports our discovery that LTA4H is a disease gene for MI comes from Aiello and coworkers. They have shown that leukotriene B4 receptor antagonism reduces monocytic foam cells in mice, suggesting that LTB4 has a role in the pathogenesis of atherosclerosis in mice. (Aiello, et al., Arteriosclerosis, Thrombosis and Vascular Biology. 2002;22:443.)

Finally, additional support of our human validation of the leukotriene pathways role in MI in general, and for LTA4H, in particular, comes from Mehrabian et al. who described the identification of 5-Lipoxygenase (5-LO) as a major gene contributing to atherosclerosis susceptibility in mice. Mehrabian et al. described that heterozygous deficiency for the enzyme in a knockout model decreased the atherosclerotic lesion size in LDL−/− mice by about 95%. Mehrabian et al show that the enzyme is expressed abundantly in macrophage-rich regions of atherosclerotic lesions, and suggested that 5-LO and/or its products might act locally to promote lesion development (Mehrabian et al., *Circulation Research*. 91:120 (2002)).

These results suggest that the Leukotriene B4 branch of the leukotriene pathway (as opposed to the other main end products of the leukotriene biosynthetic pathway: leukotriene C4, leukotriene D4, and leukotriene E4) may be more specifically involved in MI risk. If so, then medicants acting on this branch or blocking the effects of LTB4 may be more effective in preventing/treating MI than those acting on the other branches of the pathway or that block the effects of LTC4, LTD4, or LTE4. However, our current data do not exclude these other branches of the leukotriene pathway; the data do suggest that at least the LTB4 side of the leukotriene pathway is important for MI. All medicaments that act on any branch of the pathway are contemplated herein for MI prophylaxis or therapy.

Mutations and/or polymorphisms within or near the LTA4H nucleic acid, and other members of the same pathway (i.e., leukotriene B4 receptor 1 and 2, leukotriene B4 omega-hydroxylase, leukotriene B4 12-hydroxydehydrogenase), that show association with the disease, may be used as a diagnostic test to predict those at risk for MI and ACS as well as those who might benefit from medicants directed against members of the leukotriene pathway. Therefore, there may be other members of the leukotriene pathway that may be valuable therapeutic targets for myocardial infarction in addition to LTA4H and FLAP.

EXAMPLE 16 mRNA Expression of the LTA4 Hydrolase Gene in White Blood Cells of MI Patients vs Control mRNA expression was compared in white blood cells from patients with history of myocardial infarction (MI) and in age and sex matched controls without MI. The leucocyte population was separated into: 1) neutrophils and 2) peripheral blood mononuclear cells prior to RNA extraction using standardized methods as previously described (Helgadottir et al, Nature Genetics, 2004; Hakonarson et al, J Immunol, 2001).

RNA was isolated from PBM cells obtained from 43 MI patients and 35 controls. RNA was separately analyzed from granulocytes from the same subjects. Sufficient amount for RNA was obtained from all PBM cell preparations, and granulocyte preparations from 35 MI patients and 29 controls. RNA was converted into cDNA using the protocol below. PCR was then run on the cDNA with the LTA4H Assay-on-Demand and Beta Actin Pre-Developed Assay Reagent from Applied Biosystems using the PCR parameters below.

TABLE 43

PCR Parameters

RT Reaction

| | | | |
|---|---|---|---|
| TaqMan RT Buffer | 1X | | |
| MgCl2 | 5.5 mM | | |
| dNTP | 0.5 mM per dNTP | 25° C. | 10' |
| Random Hexamers | 2.5 uM | 48° C. | 30' |
| Rnase Inhibitor | 0.4 U/uL | 95° C. | 5' |
| MultiScribe Reverse Transcriptase | 1.25 U/uL | | |
| RNA | 2 ng/uL | | |
| | 50 uL Reaction Volume | | |

TABLE 43-continued

PCR Parameters

PCR Reaction

| | | | |
|---|---|---|---|
| TaqMan Universal Master Mix | 1X | 95° C. | 10' |
| TaqManAssay (20X) | 1X | | 40 cycles: |
| cDNA | 2 ng/ul (original RNA) | 95° C. | 15" |
| | 10 uL Reaction Volume | 60° C. | 60" |
| All PCR reactions run in duplicates. | | | |

ABI7900 instrument was used to calculate CT (Threshold Cycle) values. Samples displaying a greater than 1 deltaCT between duplicates were not used in our analysis. Quantity was obtained using the formula $2^{\wedge}\text{-deltaCT}$ where deltaCT represents the difference of CT values between target and housekeeping assay. mRNA expression was subsequently compared between patients and controls. To determine if there were differences between the groups, we used standardized Mann-Whitney analysis as well as Standard t tests, with $p<0.05$ considered significant. Moreover, given our hypothesis of enhanced expression of the LTA4 hydrolase gene in patients compared to controls, we report both unpaired two-sided and unpaired one-sided t tests with Welch correction.

TABLE 44

Results

Analysis

| | # | # 5% extr. | Ave Q −5% extr. |
|---|---|---|---|
| PBMC | | | |
| Patients | 43 | 2.15 | 1.954317191 |
| Controls | 35 | 1.75 | 1.72766267 |
| Granulocytes | | | |
| Patients | 35 | 1.75 | 0.401265947 |
| Controls | 29 | 1.45 | 0.331226464 |

Statistics
Granulocytes
MI patients vs
controls

P = 0.0868
Mann-Whitney
two-sided test
P = 0.0635 Unpaired two-sided t test
P = 0.0318 Unpaired one-sided t test
P = 0.0556 Unpaired two-sided t test with Welch correction
P = 0.0278 Unpaired one-sided t test with
Welch correction
Statistics PBMC Patients vs Control P = 0.0456 Mann-Whitney
two-sided test
P = 0.0591 Unpaired two-sided t test
P = 0.0296 Unpaired one-sided t test
P = 0.0656 Unpaired two-sided t test with Welch correction
P = 0.0328 Unpaired one-sided t test with
Welch correction Relative to cells isolated from control subjects, mRNA expression of LTA4 hydrolase gene is significantly enhanced in both PBM cells and granulocytes isolated from patients with MI. These data further confirmed the role of this gene in MI.

EXAMPLE 17

SNPs in the LTA4H Gene and Haplotype Association

Figure 11:
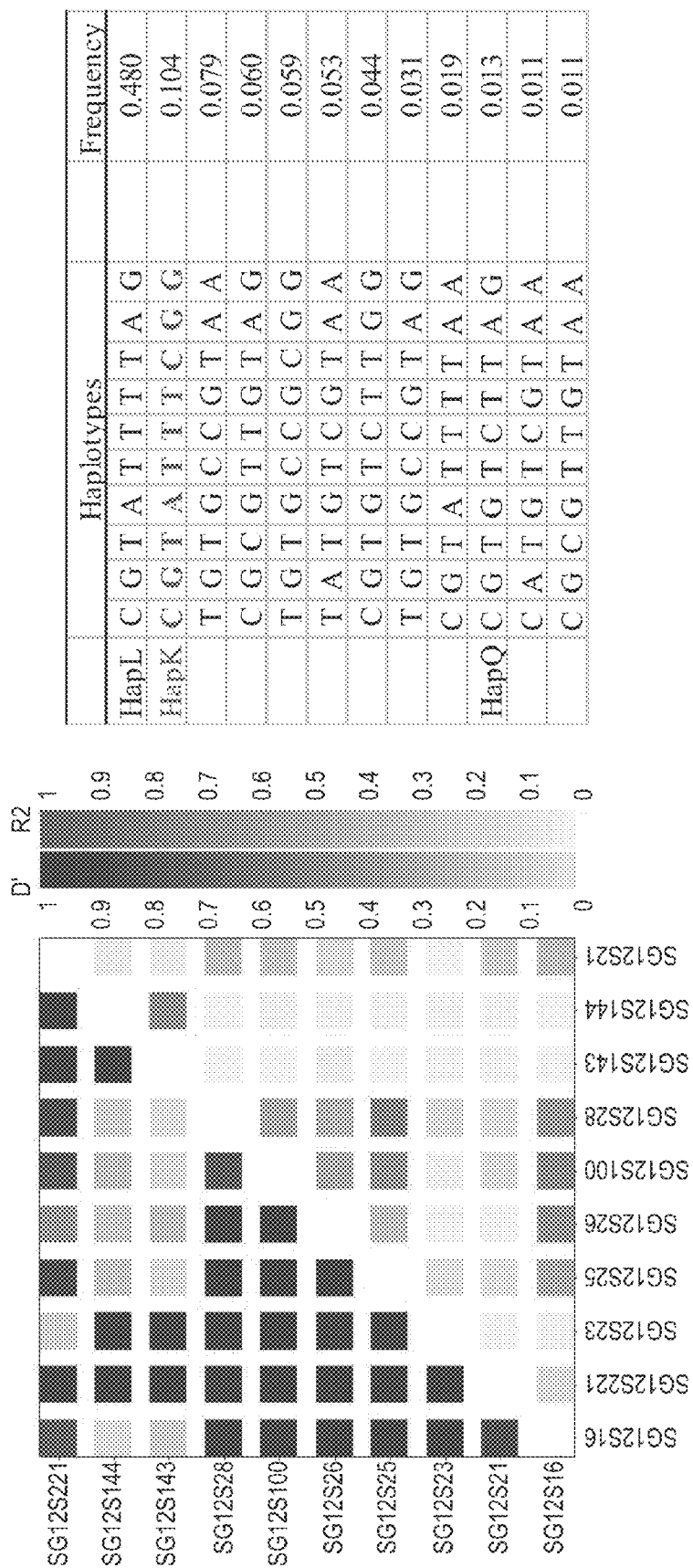
FIG. 11 shows LD and haplotypes in the LTA4H region.

Ten SNPs in the LTA4H gene, 8 from the sequenced region and 2 public SNPs in the 5' region of the gene, were selected for genotyping 1500 MI patients and 900 controls. The linkage disequilibrium (LD) pattern defined by the 10 genotyped SNPs is shown in FIG. 11, left panel. All haplotypes with greater than 1% allelic frequency that were found in the Icelandic cohort are shown in FIG. 11, right panel.

Subjects from Iceland

The study cohort included 1496 unrelated Icelandic subjects with MI (1096 males, 400 females, and 432 with early onset MI), and 867 unrelated population controls (xx males, xx females). Early onset was defined for subjects having their MI before the age of 55 for males and 65 for females. Of the 1425 patients 345 were diagnosed with more than one atherosclerotic complication (including 157 with MI and stroke but without PAOD, 148 with MI and PAOD but without stroke, and 40 with all three diseases). The recruitment of the cohort has previously been described[2]. In brief, MI patients were recruited from a registry that includes all MIs diagnosed before the age of 75 in Iceland from 1981-2002. Diagnosis of patients followed WHO-MONICA diagnostic criteria for acute MI in terms of elevations of cardiac enzymes and electrocardiographic changes[30]. The stroke diagnosis was confirmed by neurologists after examining the patients and/or reviewing their medical and radiological records. The PAOD diagnosis was confirmed by angiography showing severe atherosclerosis, and the majority (85%) has undergone angioplasty and/or vascular surgery.

The Data Protection Commission of Iceland and the National Bioethics Committee of Iceland approved the study. Informed consent was obtained from all study participants. Personal identifiers associated with medical information and blood samples were encrypted with a third party encryption system as previously described[31].

Subjects from the United States

Philadelphia

The patients and controls came from the same study cohort that was ascertained among individuals who underwent a coronary angiography in the cardiac catheterization laboratory of the University of Pennsylvania. Apart from history of MI, the diagnosis was confirmed by angiography. (Input from collaborators)

The patient group included 731 Caucasians, 103 African Americans, and 73 subjects of other or unknown ethnicity (including 4 Native Americans, 7 Hispanics, 9 of other (undefined) ethnicity and 51 of unknown ethnicity). The control group included 434 Caucasians, 128 African Americans, and 86 individuals of other or unknown ethnicity (including 5 Asians, 14 Hispanics, 11 of other (undefined) ethnicity, and 62 of unknown ethnicity).

Cleveland

The study group from Cleveland included 696 MI patients (553 males and 143 females) and 698 controls (314 males and 384 females). The majority of the study subjects were Caucasians and approximately 10% were African American. Information on the ethnicity of individuals was not available. To separate the study subjects into ethnic groups 8 microsatellite markers with different allele distributions in Caucasians and African Americans were genotyped on the study cohort. This procedure is described in detail elsewhere (submitted manuscript). In brief, the 8 markers were identified by genotyping approximately 2000 microsatellite markers in a group of 35 Caucasian Americans and 88 African Americans, with self-reported ethnicity, from many regions of the United States. The allelic frequencies of the microsatellite markers in this cohort were used as a reference when we evaluated the population stratification in the study cohort from Cleveland. Of the Caucasian MI patients 147 did also have a history of stroke and/or peripheral vascular disease.

The statistical analysis for the association study of the LTA4H gene haplotypes with MI is described above in Example 1.

Association Study

In a case-control association study, including 1500 MI patients and 900 population-based controls, 10 genotyped SNPs were tested for association to the disease. The frequency of all SNPs in the patient and control groups is shown in Table 45. One SNP or SG12S100 (rs2247570) showed nominally significant association to MI (Table 46). The frequency of allele T of this SNP was 72.4% and 69.6% in the patient and control groups respectively (P=0.043), which corresponds to a 15% increase in risk of MI for each copy of allele T carried (Table 46).

Shown are the genotyped SNPs including public names if available (variation shown in brackets), and the frequency of the underlined allele, in Caucasian, and African American cohorts, and in a cohort of unknown or other ethnicity. Each column represents an individual cohort. The ethnicity of the cohort is indicated, followed by a letter for the place from which the cohort came. The letters I identifies the cohort from Iceland, the letter P identifies the cohort from Philadelphia and the letter C identifies the cohorts from Cleveland. Also shown is the number (n) of subjects genotyped, the relative risk (RR) and the P-value for the association with MI. The P-values are two sided and are obtained with a likelihood ratio test. Public names for SNPs SG12S16 and SG12S26 are not available. The basepair positions for these two SNPs in the human genome assembly build 34 (National Center for Biotechnology Information (NCBI)) are 94896055 and 94916919, respectively

TABLE 45

| SNP allelic association to MI | | | | | | |
|---|---|---|---|---|---|---|
| SNP name (variation) | Caucasian I | Caucasian P | Caucasian C | Unknown or other P | Afr. American P | Afr. American C |
| SG12S16 (T/C) | | | | | | |
| Frq. in patients (n) | 0.232 (1521) | 0.239 (547) | 0.255 (606) | 0.167 (60) | 0.044 (80) | 0.035 (57) |
| Frq. in controls (n) | 0.233 (807) | 0.239 (333) | 0.228 (576) | 0.143 (63) | 0.06 (100) | 0.045 (89) |

TABLE 45-continued

SNP allelic association to MI

| SNP name (variation) | Caucasian I | Caucasian P | Caucasian C | Unknown or other P | Afr. American P | Afr. American C |
|---|---|---|---|---|---|---|
| RR/P-value | | | | | | |
| SG12S21/rs2660880 (A/G) | | | | | | |
| Frq. in patients (n) | 0.062 (1510) | 0.073 (704) | 0.066 (586) | 0.028 (72) | 0.021 (97) | 0.009 (55) |
| Frq. in controls (n) | 0.071 (829) | 0.062 (422) | 0.067 (568) | 0.055 (82) | 0.012 (124) | 0.006 (87) |
| RR/P-value | | | | | | |
| SG12S23/rs6538697 (T/C) | | | | | | |
| Frq. in patients (n) | 0.926 (1430) | 0.934 (715) | 0.915 (597) | 0.894 (71) | 0.842 (98) | 0.791 (55) |
| Frq. in controls (n) | 0.928 (822) | 0.911 (426) | 0.917 (569) | 0.907 (86) | 0.849 (126) | 0.858 (88) |
| RR/P-value | | | | | | |
| SG12S25/rs1978331 (A/G) | | | | | | |
| Frq. in patients (n) | 0.636 (1348) | 0.603 (718) | 0.582 (604) | 0.575 (73) | 0.38 (100) | 0.373 (55) |
| Frq. in controls (n) | 0.613 (815) | 0.599 (423) | 0.593 (577) | 0.559 (85) | 0.242 (126) | 0.273 (88) |
| RR/P-value | | | | | 1.92/0.0016 | 1.58/0.077 |
| SG12S26 (T/C) | | | | | | |
| Frq. in patients (n) | 0.831 (1442) | 0.831 (699) | 0.809 (606) | 0.854 (72) | 0.969 (96) | 0.973 (55) |
| Frq. in controls (n) | 0.827 (812) | 0.813 (417) | 0.828 (573) | 0.894 (85) | 0.955 (122) | 0.961 (89) |
| RR/P-value | | | | | | |
| SG12S100/rs2247570 (T/C) | | | | | | |
| Frq. in patients (n) | 0.724 (1496) | 0.699 (690) | 0.688 (582) | 0.671 (70) | 0.626 (95) | 0.644 (52) |
| Frq. in controls (n) | 0.696 (805) | 0.708 (409) | 0.699 (568) | 0.69 (84) | 0.533 (123) | 0.518 (85) |
| RR/P-value | 1.15/0.043 | | | | 1.47/0.049 | 1.69/0.039 |
| SG12S28/rs2660898 (T/G) | | | | | | |
| Frq. in patients (n) | 0.695 (1375) | 0.686 (711) | 0.658 (603) | 0.711 (71) | 0.798 (99) | 0.741 (56) |
| Frq. in controls (n) | 0.678 (800) | 0.665 (426) | 0.674 (579) | 0.738 (84) | 0.798 (124) | 0.817 (90) |
| RR/P-value | | | | | | |
| SG12S143/rs2540482 (C/T) | | | | | | |
| Frq. in patients (n) | 0.174 (1473) | 0.263 (716) | 0.247 (592) | 0.368 (72) | 0.285 (100) | 0.286 (56) |
| Frq. in controls (n) | 0.173 (833) | 0.207 (423) | 0.239 (562) | 0.271 (85) | 0.232 (125) | 0.256 (88) |
| RR/P-value | | 1.37/0.0025 | | 1.57/0.064 | | |
| SG12S144/rs2660845 (G/A) | | | | | | |
| Frq. in patients (n) | 0.211 (1415) | 0.30 (697) | 0.293 (564) | 0.426 (68) | 0.337 (95) | 0.349 (53) |
| Frq. in controls (n) | 0.214 (807) | 0.251 (417) | 0.298 (552) | 0.298 (84) | 0.29 (124) | 0.355 (83) |
| RR/P-value | | 1.28/0.012 | | 1.75/0.02 | | |
| SG12S221/rs2540475 (G/A) | | | | | | |
| Frq. in patients (n) | 0.821 (1438) | 0.778 (718) | 0.79 (603) | 0.856 (73) | 0.887 (97) | 0.902 (56) |
| Frq. in controls (n) | 0.821 (773) | 0.772 (428) | 0.8 (578) | 0.853 (85) | 0.861 (126) | 0.864 (88) |
| RR/P-value | | | | | | |

TABLE 46

SNP allelic association to MI

| | | | Frequency | | # genotyped | | | |
|---|---|---|---|---|---|---|---|---|
| Cohort | SNPs | Allele | Patients | Controls | Patients | Controls | RR | P |
| Iceland | | | | | | | | |
| Caucasians | SG12S100 | T | 0.724 | 0.696 | #1496 | 805 | 1.15 | 0.043 |
| Philadelphia | | | | | | | | |
| Caucasians | SG12S100 | T | 0.699 | 0.708 | #690 | 409 | 0.96 | NS |
| | SG12S143 | C | 0.263 | 0.206 | #716 | 424 | 1.37 | 0.002 |
| | SG12S144 | G | 0.30 | 0.25 | #697 | 418 | 1.28 | 0.011 |
| | SG12S23 | T | 0.934 | 0.91 | #715 | 427 | 1.39 | 0.04 |
| African | SG12S100 | T | 0.626 | 0.533 | #95 | 123 | 1.47 | 0.049 |
| Americans | SG12S143 | C | 0.285 | 0.232 | #100 | 125 | 1.32 | NS |
| | SG12S144 | G | 0.337 | 0.29 | #95 | 124 | 1.24 | NS |
| | SG12S23 | T | 0.842 | 0.849 | #98 | 126 | 0.95 | NS |
| | SG12S25 | A | 0.38 | 0.242 | #100 | 126 | 1.92 | 0.002 |
| Undefined | | | | | | | | |
| ethnicity | SG12S100 | T | 0.671 | 0.69 | #70 | 84 | 0.92 | NS |

TABLE 46-continued

SNP allelic association to MI

| Cohort | SNPs | Allele | Frequency Patients | Frequency Controls | # genotyped Patients | # genotyped Controls | RR | P |
|---|---|---|---|---|---|---|---|---|
| | SG12S143 | C | 0.368 | 0.262 | #72 | 103 | 1.64 | 0.035 |
| | SG12S144 | G | 0.426 | 0.291 | #68 | 103 | 1.8 | 0.01 |
| | SG12S23 | T | 0.894 | 0.907 | #71 | 86 | 0.87 | NS |
| | SG12S25 | A | 0.575 | 0.559 | #73 | 85 | 1.07 | NS |
| Cleveland | | | | | | | | |
| Caucasians | SG12S100 | T | 0.688 | 0.699 | #582 | 568 | 0.95 | NS |
| | SG12S143 | C | 0.247 | 0.239 | #592 | 562 | 1.05 | NS |
| | SG12S144 | G | 0.293 | 0.298 | #564 | 552 | 0.98 | NS |
| | SG12S23 | T | 0.915 | 0.917 | #597 | 569 | 0.99 | NS |
| | SG12S25 | A | 0.582 | 0.593 | #604 | 577 | 0.96 | NS |
| African Americans | SG12S100 | T | 0.644 | 0.518 | #52 | 85 | 1.69 | 0.039 |
| | SG12S143 | C | 0.292 | 0.246 | #53 | 81 | 1.26 | NS |
| | SG12S144 | G | 0.349 | 0.355 | #53 | 83 | 0.97 | NS |
| | SG12S23 | T | 0.791 | 0.858 | #55 | 88 | 0.63 | NS |
| | SG12S25 | A | 0.373 | 0.273 | #55 | 88 | 1.58 | 0.077 |

All haplotypes defined by the genotyped SNPs were tested for association to MI. As shown in Table 47 no haplotype is significantly over-represented in all MI patients. Since males with MI showed suggestive linkage to the chromosome 12q22-23 region, this phenotype was also tested for association. In addition we tested haplotype association to more severe MI phenotypes, or early onset MI, and MI with another clinical manifestation of atherosclerosis (PAOD and/or stroke). The phenotypes MI in males or early onset disease did not show significant association to any of the tested haplotypes. However, as shown in Table 48, MI with additional atherosclerotic manifestation showed an association to a haplotype that we call HapK. The allelic frequency of HapK in patients with additional atherosclerotic manifestation and in controls is 14.5% and 10.4%, respectively, which corresponds to a relative risk (RR) of 1.45 (P=0.0091), for each copy of HapK carried.

Since proper interpretation of the significance of the association of the SNP SG12S100 and haplotype HapK to MI has to take multiple comparisons into account, the P-values were adjusted for the number of tests made, corresponding to the number of haplotypes tested, by randomizing the patients and controls. The significance of the association of SNP SG12S100 to MI did not survive this adjustment at 0.05 level. However, the association of HapK to MI with additional atherosclerotic complication could still be considered significant with adjusted P-value 0.035. However, since the adjusted P-value still does not take the multiple phenotypes tested into account we consider this haplotype only marginally significant with the Icelandic data only. Hence, this candidate at-risk variant called for confirmation in an independent cohort.

Tables 46: Shown are all observed haplotypes with frequency greater than 1% in the population controls for each indicated cohort, and the allelic frequency in patients and controls. Also shown is the relative risk (RR) and the P-value for the association to MI.

47a. Iceland-Caucasians (1555 patients/863 controls) Patients = All MI

| SG12S16 | SG12S21 | SG12S23 | SG12S25 | SG12S26 | SG12S100 | SG12S28 | SG12S143 | SG12S144 | SG12S221 | P | RR | Frequency Patients | Frequency Controls | Name |
|---|---|---|---|---|---|---|---|---|---|---|---|---|---|---|
| C | G | T | A | T | T | T | T | A | G | 2.7E-01 | 1.07 | 0.497 | 0.480 | HapL |
| C | G | T | A | T | T | T | C | G | G | 3.8E-01 | 1.09 | 0.112 | 0.104 | HapK |
| T | G | T | G | C | C | G | T | A | A | 2.3E-01 | 1.15 | 0.090 | 0.079 | |
| C | G | C | G | T | T | G | T | A | G | 5.8E-01 | 1.07 | 0.064 | 0.060 | |
| T | G | T | G | C | C | G | C | G | G | 9.2E-01 | 0.99 | 0.058 | 0.059 | |
| T | A | T | G | T | C | G | T | A | A | 4.7E-01 | 0.90 | 0.048 | 0.053 | |
| C | G | T | G | T | C | T | T | G | G | 2.9E-02 | 0.70 | 0.031 | 0.044 | |
| T | G | T | G | C | C | G | T | A | G | 1.0E-01 | 0.71 | 0.022 | 0.031 | |
| C | G | T | A | T | T | T | T | A | A | 7.4E-01 | 0.92 | 0.018 | 0.019 | |
| C | G | T | G | T | C | T | T | A | G | 1.1E-01 | 0.61 | 0.008 | 0.013 | HapQ |

47a. Iceland-Caucasians (1555 patients/863 controls) Patients = All MI

| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | A | T | G | T | C | G | T | A | A | 9.1E-02 | 0.57 | 0.006 | 0.011 | |
| C | G | C | G | T | T | G | T | A | A | 7.0E-01 | 1.13 | 0.012 | 0.011 | |

47b. Iceland-Caucasians (325 patients/863 controls) Patients = MI with additional CVD

| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | T | A | T | T | T | T | A | G | 8.7E-01 | 0.98 | 0.477 | 0.480 | HapL |
| C | G | T | A | T | T | T | C | G | G | 9.1E-03 | 1.45 | 0.145 | 0.104 | HapK |
| T | G | T | G | C | C | G | T | A | A | 5.5E-01 | 1.11 | 0.086 | 0.079 | |
| C | G | C | G | T | T | G | T | A | G | 8.6E-01 | 0.97 | 0.058 | 0.060 | |
| T | G | T | G | C | C | G | C | G | G | 5.4E-01 | 0.88 | 0.051 | 0.059 | |
| T | A | T | G | T | C | G | T | A | A | 8.9E-01 | 0.97 | 0.051 | 0.053 | |
| C | G | T | G | T | C | T | T | G | G | 8.8E-03 | 0.48 | 0.021 | 0.044 | |
| T | G | T | G | C | C | G | T | A | G | 9.6E-01 | 0.99 | 0.032 | 0.031 | |
| C | G | T | A | T | T | T | T | A | A | 1.4E-01 | 0.51 | 0.010 | 0.019 | |
| C | G | T | G | T | C | T | T | A | G | 4.1E-01 | 0.67 | 0.009 | 0.013 | HapQ |
| C | A | T | G | T | C | G | T | A | A | 2.6E-01 | 0.54 | 0.006 | 0.011 | |
| C | G | C | G | T | T | G | T | A | A | 9.5E-01 | 0.97 | 0.011 | 0.011 | |

47c. Philadelphia-Caucasians (731 patients/434 controls)

| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | T | A | T | T | T | T | A | G | 4.5E-02 | 0.83 | 0.363 | 0.406 | HapL |
| C | G | T | A | T | T | T | C | G | G | 1.5E-02 | 1.34 | 0.185 | 0.145 | HapK |
| T | G | T | G | C | C | G | T | A | A | 3.7E-01 | 0.88 | 0.098 | 0.110 | |
| C | G | C | G | T | T | G | T | A | G | 8.9E-02 | 0.72 | 0.048 | 0.065 | |
| T | G | T | G | C | C | G | C | G | G | 7.5E-01 | 0.94 | 0.048 | 0.051 | |
| T | A | T | G | T | C | G | T | A | A | 3.3E-01 | 1.21 | 0.060 | 0.050 | |
| C | G | T | A | T | T | T | T | A | A | 5.9E-01 | 1.17 | 0.030 | 0.026 | |
| C | G | C | G | T | T | G | T | A | A | 1.3E-01 | 0.59 | 0.013 | 0.022 | |
| C | G | T | G | T | C | T | T | G | G | 7.6E-01 | 1.10 | 0.023 | 0.021 | |
| T | G | T | G | C | C | G | T | A | G | 8.8E-01 | 0.94 | 0.018 | 0.019 | |
| C | G | T | G | T | C | T | T | A | G | 8.3E-02 | 1.75 | 0.027 | 0.016 | HapQ |

47c. Philadelphia-Caucasians (731 patients/434 controls)

| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | T | G | T | T | T | T | A | G | 1.2E-01 | 0.47 | 0.007 | 0.014 | |
| C | G | T | G | T | T | T | T | G | G | 3.7E-01 | 1.41 | 0.017 | 0.012 | |

47d. Cleveland-Caucasians (614 patients/583 controls)

| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | T | A | T | T | T | T | A | G | 7.4E-01 | 0.97 | 0.380 | 0.386 | HapL |
| C | G | T | A | T | T | T | C | G | G | 8.8E-01 | 1.02 | 0.163 | 0.160 | HapK |
| T | G | T | G | C | C | G | T | A | A | 4.2E-01 | 1.12 | 0.100 | 0.091 | |
| C | G | C | G | T | T | G | T | A | G | 7.9E-01 | 1.05 | 0.064 | 0.061 | |
| T | G | T | G | C | C | G | C | G | G | 8.7E-01 | 0.97 | 0.057 | 0.058 | |
| T | A | T | G | T | C | G | T | A | A | 7.8E-01 | 1.05 | 0.053 | 0.050 | |
| C | G | T | G | T | C | T | T | G | G | 6.7E-01 | 0.90 | 0.030 | 0.033 | |
| C | G | T | G | T | C | T | T | A | G | 9.8E-01 | 1.01 | 0.023 | 0.023 | HapQ |
| C | G | T | A | T | T | T | T | A | A | 9.1E-01 | 0.97 | 0.021 | 0.022 | |
| C | G | C | G | T | T | G | T | A | A | 6.7E-01 | 0.86 | 0.016 | 0.019 | |
| T | G | T | G | C | C | G | T | A | G | 6.5E-01 | 1.17 | 0.021 | 0.018 | |
| C | G | T | G | T | T | T | T | G | G | 8.2E-01 | 0.92 | 0.013 | 0.014 | |
| C | G | T | A | T | T | T | C | A | G | 3.9E-01 | 0.64 | 0.007 | 0.010 | |

47e. Philadelphia- Other or unknown ethnicity (73 patients/86 controls)

| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | T | A | T | T | T | T | A | G | 7.7E-02 | 0.64 | 0.274 | 0.370 | HapL |
| C | G | T | A | T | T | T | C | G | G | 1.1E-02 | 2.04 | 0.283 | 0.162 | HapK |
| C | G | T | G | T | C | T | T | A | G | 3.2E-01 | 0.59 | 0.045 | 0.074 | HapQ |
| T | A | T | G | T | C | G | T | A | A | 2.5E-01 | 0.51 | 0.027 | 0.052 | |
| T | G | T | G | C | C | G | T | A | A | 6.7E-01 | 1.24 | 0.059 | 0.048 | |
| C | G | C | G | T | T | G | T | A | G | 9.0E-01 | 0.93 | 0.041 | 0.044 | |
| C | G | T | G | T | T | T | T | A | G | 5.7E-01 | 0.69 | 0.027 | 0.039 | |
| C | G | T | G | T | T | T | T | G | G | 1.8E-01 | 2.22 | 0.058 | 0.027 | |
| T | G | T | G | C | C | G | T | A | G | 8.7E-01 | 0.84 | 0.021 | 0.025 | |
| C | G | C | G | T | C | G | C | G | G | 9.4E-01 | 0.94 | 0.020 | 0.021 | |
| T | G | T | G | C | C | G | C | G | G | 5.7E-02 | 3.88 | 0.063 | 0.017 | |

| 47e. Philadelphia- Other or unknown ethnicity (73 patients/86 controls) ||||||||||||||||
| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | C | G | T | T | G | T | A | A | 1.8E-01 | 2.65 | 0.041 | 0.016 | |
| C | G | T | G | T | T | T | T | G | G | 9.1E-02 | 0.00 | 0.000 | 0.014 | |
| T | G | T | G | T | T | T | C | G | G | 1.2E-01 | 0.00 | 0.000 | 0.012 | |
| T | G | T | G | C | C | G | C | G | A | 2.6E-01 | 0.00 | 0.000 | 0.010 | |

| 47f. Philadelphia-African Americans (103 patients/128 controls) ||||||||||||||||
| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Frequency Controls | Name |
|---|---|---|---|---|---|---|---|---|---|---|---|---|---|---|
| C | G | T | G | T | C | T | T | A | G | 3.4E-02 | 0.53 | 0.119 | 0.202 | HapQ |
| C | G | T | G | T | T | T | T | A | G | 4.8E-02 | 0.55 | 0.110 | 0.183 | |
| C | G | T | A | T | T | T | T | A | G | 2.5E-02 | 1.77 | 0.235 | 0.148 | HapL |
| C | G | C | G | T | T | G | T | A | G | 4.7E-01 | 1.38 | 0.073 | 0.054 | |
| C | G | T | G | T | C | T | T | G | G | 4.8E-01 | 1.34 | 0.070 | 0.054 | |
| C | G | T | G | T | C | T | C | G | G | 1.9E-01 | 0.29 | 0.013 | 0.042 | |
| C | G | C | G | T | C | G | C | G | G | 5.3E-01 | 0.65 | 0.026 | 0.039 | |
| C | G | T | A | T | C | T | C | G | A | 5.4E-01 | 0.70 | 0.026 | 0.036 | |
| C | G | T | G | T | C | T | T | A | A | 6.1E-02 | 0.18 | 0.006 | 0.033 | |
| C | G | C | G | T | C | G | T | A | G | 3.6E-01 | 0.48 | 0.014 | 0.029 | |
| C | G | C | G | T | T | G | C | G | G | 3.9E-01 | 0.48 | 0.014 | 0.029 | |
| C | G | T | A | T | T | T | T | A | A | 9.0E-01 | 0.90 | 0.020 | 0.022 | |
| C | G | T | A | T | T | T | C | G | G | 4.9E-04 | 5.48 | 0.105 | 0.021 | HapK |
| C | G | T | G | T | T | T | C | G | G | 5.9E-01 | 1.46 | 0.028 | 0.019 | |
| T | G | T | G | C | C | G | T | A | G | 7.0E-01 | 0.70 | 0.012 | 0.012 | |
| C | G | T | A | T | T | T | C | G | A | 7.6E-01 | 1.42 | 0.018 | 0.018 | |
| T | G | T | G | C | C | G | C | G | G | 7.7E-01 | 0.74 | 0.009 | 0.009 | |
| C | G | T | G | T | T | T | T | G | G | 3.0E-01 | 0.00 | 0.000 | 0.000 | |
| T | G | T | G | C | C | G | T | A | A | 5.1E-01 | 0.17 | 0.002 | 0.002 | |

| 47q. Cleveland-African Americans (57patients/90controls) | | | | | | | | | | | | | | |
|---|---|---|---|---|---|---|---|---|---|---|---|---|---|---|
| SG 12S16 | SG 12S21 | SG 12S23 | SG 12S25 | SG 12S26 | SG 12S100 | SG 12S28 | SG 12S143 | SG 12S144 | SG 12S221 | P | RR | Frequency Patients | Controls | Name |
| C | G | T | G | T | C | T | T | A | G | 7.3E-02 | 0.51 | 0.116 | 0.206 | HapQ |
| C | G | T | A | T | T | T | T | A | G | 2.5E-01 | 1.51 | 0.196 | 0.140 | HapL |
| C | G | T | G | T | T | T | T | A | G | 8.3E-01 | 0.91 | 0.096 | 0.105 | |
| C | G | T | G | T | C | T | T | G | G | 5.6E-02 | 0.33 | 0.031 | 0.087 | |
| C | G | T | G | T | T | T | C | G | G | 4.4E-01 | 0.58 | 0.038 | 0.064 | |
| C | G | T | A | T | T | T | C | G | G | 2.1E-02 | 2.89 | 0.153 | 0.059 | HapK |
| C | G | C | G | T | T | G | T | A | G | 1.9E-01 | 1.97 | 0.101 | 0.054 | |
| C | G | C | G | T | C | G | T | A | G | 2.6E-01 | 1.92 | 0.083 | 0.045 | |
| C | G | T | G | T | C | T | C | G | G | 8.8E-01 | 0.88 | 0.037 | 0.041 | |
| C | G | T | A | T | T | T | C | G | A | 2.1E-02 | 0.00 | 0.000 | 0.041 | |
| T | G | T | G | C | C | G | T | A | A | 4.0E-01 | 0.52 | 0.018 | 0.033 | |
| C | G | T | G | T | T | T | T | A | A | 1.5E-01 | 0.00 | 0.000 | 0.014 | |
| C | G | C | G | T | C | G | C | G | G | 4.9E-01 | 2.02 | 0.029 | 0.014 | |
| C | G | T | A | T | C | T | C | G | A | 1.9E-01 | 0.00 | 0.000 | 0.013 | |
| C | G | T | A | T | T | T | T | A | A | 5.1E-01 | 2.35 | 0.023 | 0.010 | |
| C | G | T | G | T | C | T | T | A | A | 3.9E-01 | 3.26 | 0.031 | 0.010 | |

TABLE 48

The association of HapK to MI

| Cohorts (n) | Frequency Patients | Controls | RR | P-value |
|---|---|---|---|---|
| Iceland | | | | |
| Caucasians, all MI (1555/863) | 0.112 | 0.104 | 1.09 | NS |
| Early onset (725/863) | 0.114 | 0.104 | 1.10 | NS |
| MI and additional CVD (325/863) | 0.145 | 0.104 | 1.45 | 0.0091 |
| Philadelphia | | | | |
| Caucasians, all MI (731/434) | 0.185 | 0.145 | 1.34 | 0.015 |
| African Americans, all MI (103/128) | 0.105 | 0.021 | 5.28 | 0.00049 |
| Other or undefined ethnicity, all MI (73/86) | 0.283 | 0.162 | 2.04 | 0.011 |
| Cleveland | | | | |
| Caucasians, all MI (614/583) | 0.163 | 0.160 | 1.02 | NS |
| MI and additional CVD (147/601) | 0.183 | 0.160 | 1.20 | NS |
| African Americans, all MI (57/90) | 0.153 | 0.059 | 2.89 | 0.021 |

EXAMPLE 18

A Replication Study of SNPs in LTA4H Gene in US Cohorts

In a replication study, the putative association of HapK to MI was assessed in independent study cohorts from Philadelphia and Cleveland. The cohort from Philadelphia included 901 subjects who had suffered a MI and 738 controls, who had undergone coronary angiography and had no evidence of coronary artery disease. The ethnicity of the individuals from Philadelphia was self-reported. The cohort from Cleveland included 696 MI patients and 698 controls.

The 10 SNPs, genotyped in the Icelandic cohort, were typed in the US cohorts and in addition to testing haplotype association, association to single SNPs in each ethnic group was tested separately. Table 45 (above) shows the frequency of all genotyped SNPs in the US and Icelandic cohorts. The frequency of the SNPs is quite similar in the three Caucasian groups on one hand and in the two African American cohorts on the other hand. However, as expected the frequency of many of the SNPs differs between the two ethnic groups. As shown in Table 46 (above) the nominally significant association of SNP SG12S100 to MI in the Icelandic cohort does not hold up in the US Caucasians. However, the association of this SNP to MI is replicated in both African American groups. The frequency of allele T is 62.6% and 53.3% in African American patients and controls from Philadelphia respectively (P=0.049), which corresponds to a RR of 1.47 for each T allele. The corresponding frequency in African Americans from Cleveland is 64.4% and 51.8% (P=0.039) and the RR of MI for carriers of each T allele is 1.69.

Furthermore, another SNP, or SG12S25 (rs1978331), associates with MI in African Americans from Philadelphia; the frequency of allele A is 38.0% and 24.2% in patients and controls respectively (P=0.0016). Similar frequencies of this SNP were observed in the African American cohort from Cleveland, or 37.3% and 27.3% in patients and controls respectively (P-value 0.077). As shown in Table 45 (above), three SNPs, SG12S143 (rs2540482), SG12S144 (rs2660845), and SG12S23 (rs6538697) show single marker association to MI in Caucasians from Philadelphia, with respective P-values 0.0023, 0.011 and 0.04. The association of SG12S144 to MI was replicated in the cohort from Philadelphia that included subjects of other or unknown ethnicity, with P-value 0.02. Furthermore, we observed that the at-risk allele (C) of SG12S143 is over-represented in the patients of unknown or other ethnicity and in both African American cohorts, and the at-risk allele (G) of SG12S144 in African Americans from Philadelphia, although the association was not significant in these cohorts. No significant association between SNPs and MI was observed in Caucasians from Cleveland (Table 46). However, we observed that allele C of SG12S143 is over-represented in the subgroup of MI patients that also had history of other atherosclerotic manifestations, including stroke or peripheral vascular disease; the frequency in this patient group is 29.2% compared to a 23.9% frequency in the control group (P=0.06). In addition, the frequency of allele G of SG12S144 in MI patients with additional atherosclerotic manifestations is 34.8% compared to a 29.8% frequency in the control group (P=0.09).

Table 47 (above) shows the frequency of all observed haplotypes in the US and Icelandic cohorts. In addition, LD maps for US Caucasians and African Americans are shown in a Table 47.

Table 48 shows haplotype association results for the Icelandic at-risk haplotype HapK in the US cohorts. As shown in Table 48, although the haplotype frequency of HapK differs substantially between the ethnic groups, HapK associates with MI in all groups except in Caucasians from Cleveland. The haplotype frequency of HapK in the Caucasian patient and control groups from Philadelphia is 18.5% and 14.5%, respectively (P=0.015), which corresponds to a 1.34 RR of MI for each copy of HapK carried. While the haplotype frequency of HapK was less in patients and controls of African American origin from Philadelphia, or 10.5% versus 2.1% respectively, the RR of MI for carriers of HapK in this cohort is more than 5 (P=0.00049) (Table 49). The haplotype frequency of HapK in the subjects from Philadelphia with other or unknown ethnicity, was 28.3% and 16.2% in the patients and controls respectively (P=0.011), which corresponds to a 2-fold increase in risk of MI for each copy of HapK carried. Furthermore, HapK significantly associated with MI in the small African American cohort from Cleveland, conferring almost 3-fold increase in risk of MI for each copy of HapK carried (P=0.021). Association of HapK to MI in the Caucasian cohort from Cleveland was not observed (Table 48). However, we observed that the frequency of HapK in the subgroup of MI patients that also had history of other atherosclerotic manifestations is greater than in the total MI group (Table 48).

Haplotype Diversity and Association in African Americans

The haplotype diversity in the LTA4H region in the African American cohorts is quite different from that in the Caucasian cohorts (Table 47). For example, the allelic frequency of the most common haplotype (HapL) in Caucasians is ~40% and 48% in the US and Icelandic cohorts respectively. In contrast, the frequency of HapL in the African American controls is only 14-15%. In addition, the allelic frequency of the most common haplotype in African Americans, that we call HapQ, is 20%, but the frequency of HapQ in the Caucasian cohorts is ten times less. The haplotype diversity in the cohort including individuals of other or unknown ethnicity appears to be much closer to the diversity in Caucasians (Table 47).

Given the distinct haplotype diversity of African Americans, additional haplotypes for association to MI in this ethnic group were tested. Table 49 shows two haplotypes that in addition to HapK show association to MI in the African American cohorts. As shown in Table 49, the allelic frequency of HapL in African Americans from Philadelphia is 23.5% and 14.8% in patients and controls respectively (P=0.025) which corresponds to a RR of 1.77. Similar frequency of HapL was observed in the African American cohort from Cleveland or 19.6% and 14.0% in patients and controls respectively, with RR 1.51, but the sample size is small and the P-value was not significant in this cohort.

Furthermore we found a nominally significant association of HapQ, the most common haplotype in our African American cohorts, to MI. As shown in Table 49, the frequency of HapQ in the African Americans from Philadelphia was less in the patients than in controls, or 11.9% and 20.2% respectively (P=0.034). We further observed that the frequency of HapQ in the African American cohort from Cleveland was again similar to that in Philadelphia, or 11.6% and 20.6% in patients and controls respectively.

We repeated the association tests for HapL and HapQ in the African American cohorts from Philadelphia and Cleveland combined. In this combined group the RR of MI for HapL was 1.62 with P=0.019 and for HapQ the RR was 0.51 and P=0.0047 (Table 49).

In apparent contrast, the frequency of HapL in Caucasians from Philadelphia, is less in patients than in controls, or 36.3% and 40.6% respectively (P=0.045) (Table 47). Significant under-representation of HapL in patients is not observed in any other cohorts tested. HapQ, which is relatively rare (~1-2% allelic frequency) in the Caucasian cohorts, did not show significant association to MI in these ethnic groups (Table 47).

TABLE 49

Haplotypes associated with MI in African Americans

| Cohorts (n) | Haplotype | Frequency Patients | Frequency Controls | RR | P |
|---|---|---|---|---|---|
| Philadelphia | | | | | |
| African Americans | HapL | 0.235 | 0.148 | 1.77 | 0.025 |
| (103/128) | HapQ | 0.119 | 0.202 | 0.53 | 0.034 |
| Cleveland | | | | | |
| African Americans | HapL | 0.196 | 0.14 | 1.51 | NS |
| (57/90) | HapQ | 0.116 | 0.206 | 0.51 | NS |
| African American | HapL | | | 1.62 | 0.019 |
| cohorts combined | HapQ | | | 0.51 | 0.0047 |
| (160/213) | | | | | |

EXAMPLE 19

Correlation Between LTB4 Production and HapK

To determine whether the MI-associated haplotype HapK correlates with LTB4 production we measured LTB4 from peripheral blood neutrophils isolated from 41 patients with a previous history of MI and 35 controls, whose medical history was unknown. A study including the same sample set, which showed that stimulated neutrophils from patients with a past history of MI produced more LTB4 than those of controls, is described above. To obtain the HapK-carrier status of these individuals, the SNPs defining HapK on DNA samples from the same subjects were genotyped. Seven patients and seven controls carried HapK. The ionomycin stimulated cells from individuals (both patients and controls) carrying the MI-associated haplotype, HapK, produced significantly more LTB4 than those from non-carriers. The P-values for the correlation with HapK are 0.01 and 0.008 for the LTB4 production after stimulation for 15 and 30 minutes respectively. Age and gender of the individuals does not correlate with the LTB4 production.

EXAMPLE 20

HapK is Associated with More Severe MI Phenotypes

Ten SNPs were tested for association to MI using 1553 MI cases and 863 population-based controls. No single SNP or haplotype defined by the ten SNPs were found to be significantly more common in all MI patients than in controls (Tables 49 and 50). Subsequently, HapK association to more severe MI phenotypes, i.e. early onset MI, or MI with other cardiovascular diseases (CVD), including peripheral vascular disease and/or stroke were tested. Early onset MI did not show significant association to any of the haplotypes. However, MI with additional CVD yielded an association to a HapK (Table 51). The frequency of HapK in MI patients that had additional CVD and in controls was 14.5% and 10.4%, respectively, which corresponds to a RR of 1.45 (P=0.0091) for each copy of HapK carried. This association remained significant (P=0.035) after adjusting for the number of haplotypes tested.

TABLE 50

| | SNP allelic association to MI | | | | | | |
|---|---|---|---|---|---|---|---|
| | | European Americans | | | African Americans | | |
| SNP (variation) | Iceland | Philadelphia | Cleveland | Atlanta | Philadelphia | Cleveland | Atlanta |
| SG12S16 (T/C) | | | | | | | |
| Frq. in patients (n) | 0.233 (1515) | 0.239 (545) | 0.250 (619) | 0.274 (234) | 0.043 (82) | 0.019 (52) | 0.013 (39) |
| Frq. in controls (n) | 0.233 (807) | 0.238 (332) | 0.239 (782) | 0.253 (419) | 0.062 (97) | 0.045 (111) | 0.042 (120) |
| RR/P-value | 1.00/0.98 | 1.01/0.94 | 1.06/0.49 | 1.11/0.42 | 0.68/0.42 | 0.42/0.22 | 0.30/0.18 |
| rs2660880 (A/G) | | | | | | | |
| Frq. in patients (n) | 0.062 (1505) | 0.073 (701) | 0.066 (599) | 0.045 (223) | 0.020 (99) | 0.010 (49) | 0.000 (38) |
| Frq. in controls (n) | 0.071 (829) | 0.061 (418) | 0.070 (768) | 0.056 (516) | 0.012 (123) | 0.005 (108) | 0.015 (136) |
| RR/P-value | 0.87/0.25 | 1.22/0.26 | 0.93/0.65 | 0.79/0.36 | 1.67/0.50 | 2.22/0.58 | 0.00/0.16 |
| rs6538697 (T/C) | | | | | | | |
| Frq. in patients (n) | 0.926 (1425) | 0.933 (711) | 0.915 (610) | 0.942 (233) | 0.847 (101) | 0.765 (51) | 0.859 (39) |
| Frq. in controls (n) | 0.928 (822) | 0.910 (422) | 0.914 (776) | 0.916 (528) | 0.848 (125) | 0.849 (109) | 0.826 (144) |
| RR/P-value | 0.98/0.84 | 1.38/0.045 | 1.01/0.97 | 1.50/0.068 | 0.99/0.97 | 0.58/0.073 | 1.28/0.49 |
| rs1978331 (A/G) | | | | | | | |
| Frq. in patients (n) | 0.635 (1344) | 0.605 (715) | 0.583 (617) | 0.606 (227) | 0.373 (102) | 0.340 (50) | 0.294 (34) |
| Frq. in controls (n) | 0.613 (815) | 0.598 (419) | 0.588 (782) | 0.596 (537) | 0.240 (125) | 0.266 (109) | 0.219 (146) |
| RR/P-value | 1.10/0.15 | 1.03/0.74 | 0.98/0.80 | 1.04/0.72 | 1.88/0.002 | 1.42/0.18 | 1.48/0.20 |
| rs17677715 (T/C) | | | | | | | |
| Frq. in patients (n) | 0.830 (1436) | 0.832 (695) | 0.814 (619) | 0.776 (230) | 0.965 (99) | 0.990 (52) | 0.986 (35) |
| Frq. in controls (n) | 0.827 (812) | 0.812 (413) | 0.824 (780) | 0.803 (539) | 0.959 (121) | 0.959 (110) | 0.952 (146) |
| RR/P-value | 1.02/0.81 | 1.15/0.22 | 0.94/0.52 | 0.85/0.23 | 1.18/0.75 | 4.39/0.094 | 3.47/0.16 |
| rs2247570 (T/C) | | | | | | | |
| Frq. in patients (n) | 0.723 (1496) | 0.700 (686) | 0.691 (595) | 0.676 (236) | 0.622 (98) | 0.649 (47) | 0.462 (39) |
| Frq. in controls (n) | 0.696 (805) | 0.710 (405) | 0.696 (759) | 0.698 (497) | 0.525 (122) | 0.523 (107) | 0.475 (140) |
| RR/P-value | 1.14/0.052 | 0.95/0.62 | 0.97/0.76 | 0.90/0.39 | 1.49/0.039 | 1.68/0.040 | 0.95/0.83 |
| rs2660898 (T/G) | | | | | | | |
| Frq. in patients (n) | 0.694 (1374) | 0.686 (708) | 0.663 (616) | 0.665 (233) | 0.797 (101) | 0.735 (51) | 0.842 (38) |
| Frq. in controls (n) | 0.678 (800) | 0.664 (421) | 0.665 (785) | 0.654 (515) | 0.798 (124) | 0.806 (111) | 0.755 (141) |
| RR/P-value | 1.07/0.29 | 1.10/0.28 | 0.99/0.92 | 1.05/0.68 | 0.99/0.97 | 0.67/0.15 | 1.73/0.098 |
| rs2540482 (C/T) | | | | | | | |
| Frq. in patients (n) | 0.174 (1472) | 0.260 (713) | 0.249 (606) | 0.244 (232) | 0.299 (102) | 0.265 (49) | 0.303 (33) |
| Frq. in controls (n) | 0.173 (833) | 0.208 (420) | 0.232 (762) | 0.235 (531) | 0.230 (124) | 0.303 (109) | 0.241 (147) |
| RR/P-value | 1.00/0.95 | 1.34/0.005 | 1.10/0.29 | 1.05/0.73 | 1.43/0.096 | 0.83/0.47 | 1.37/0.31 |
| rs2660845 (G/A) | | | | | | | |
| Frq. in patients (n) | 0.210 (1414) | 0.298 (694) | 0.292 (577) | 0.273 (225) | 0.345 (97) | 0.357 (49) | 0.329 (38) |
| Frq. in controls (n) | 0.214 (807) | 0.248 (412) | 0.286 (753) | 0.257 (514) | 0.298 (124) | 0.379 (103) | 0.301 (138) |
| RR/P-value | 0.98/0.76 | 1.29/0.010 | 1.03/0.74 | 1.09/0.51 | 1.24/0.29 | 0.91/0.72 | 1.14/0.64 |
| rs2540475 (G/A) | | | | | | | |
| Frq. in patients (n) | 0.822 (1438) | 0.777 (716) | 0.790 (616) | 0.794 (223) | 0.883 (98) | 0.882 (51) | 0.857 (35) |
| Frq. in controls (n) | 0.821 (773) | 0.770 (424) | 0.793 (786) | 0.802 (534) | 0.864 (125) | 0.858 (109) | 0.854 (144) |
| RR/P-value | 1.00/0.99 | 1.04/0.72 | 0.98/0.82 | 0.95/0.70 | 1.31/0.36 | 1.24/0.54 | 0.95/1.02 |

Shown in Table 50 are the genotyped SNPs (variation shown in brackets) and the frequency of the underlined allele, in the Icelandic, and the European and African American cohorts. Also shown is the number (n) of subjects genotyped, the relative risk (RR) and the P-value for the association with MI. The P-values are two sided and are obtained with a likelihood ratio test. A public name for SNP SG12S16 is not available. The basepair position on chromosome 12 for this SNPs in the human genome assembly build 34 (National Center for Biotechnology Information (NCBI)) is 94896055.

TABLE 51

| | Frequency of haplotypes derived from HapK SNPs | | | | | | | |
|---|---|---|---|---|---|---|---|---|
| | Iceland | | | | | | | Philadelphia: European Americans |
| | | All MI patients (1553) | | | MI patients with 2CVD (325) | | | |
| | Ctrl (863) | | | | | | | Ctrl (430) |
| Haplotype | Frq | Frq | RR | P-val | Frq | RR | P-val | Frq |
| CATGTCGTAA | 1.1% | 0.6% | 0.57 | 0.094 | 0.6% | 0.54 | 0.261 | — |
| CGCGTCGCAG | — | — | — | — | — | — | — | — |
| CGCGTCGCGG | — | — | — | — | — | — | — | — |
| CGCGTCGTAG | — | — | — | — | — | — | — | — |
| CGCGTTGCAG | — | — | — | — | — | — | — | — |
| CGCGTTGCGG | — | — | — | — | — | — | — | — |
| CGCGTTGTAA | 1.1% | 1.1% | 1.02 | 0.953 | 1.1% | 0.97 | 0.947 | 2.2% |
| CGCGTTGTAG | 6.0% | 6.5% | 1.09 | 0.519 | 5.8% | 0.97 | 0.864 | 6.5% |
| CGCGTTGTGG | — | — | — | — | — | — | — | — |
| CGCGTTTTAA | — | — | — | — | — | — | — | — |
| CGTATCTCGA | — | — | — | — | — | — | — | — |
| CGTATCTCGG | — | — | — | — | — | — | — | — |
| CGTATCTTAG | — | — | — | — | — | — | — | — |
| CGTATTGCGG | — | — | — | — | — | — | — | — |
| CGTATTGTAG | — | — | — | — | — | — | — | — |
| CGTATTTCAG | — | — | — | — | — | — | — | 0.4% |
| CGTATTTCGA | — | — | — | — | — | — | — | — |
| CGTATTTCGG | 10.4% | 11.3% | 1.10 | 0.357 | 14.5% | 1.45 | 0.009 | 14.3% |
| CGTATTTTAA | 1.9% | 1.7% | 0.87 | 0.594 | 1.0% | 0.51 | 0.141 | 2.6% |
| CGTATTTTAG | 48.0% | 49.7% | 1.07 | 0.274 | 47.7% | 0.98 | 0.871 | 40.6% |
| CGTGTCGTAG | — | — | — | — | — | — | — | — |
| CGTGTCGTGG | — | — | — | — | — | — | — | — |
| CGTGTCTCAG | — | — | — | — | — | — | — | — |
| CGTGTCTCGA | — | — | — | — | — | — | — | — |
| CGTGTCTCGG | — | — | — | — | — | — | — | — |
| CGTGTCTTAA | — | — | — | — | — | — | — | — |
| CGTGTCTTAG | 1.3% | 0.8% | 0.61 | 0.118 | 0.9% | 0.67 | 0.407 | 1.6% |
| CGTGTCTTGA | — | — | — | — | — | — | — | — |
| CGTGTCTTGG | 4.4% | 3.0% | 0.68 | 0.018 | 2.1% | 0.48 | 0.009 | 1.9% |
| CGTGTTGTAA | — | — | — | — | — | — | — | — |
| CGTGTTTCAG | — | — | — | — | — | — | — | — |

TABLE 51-continued

| Haplotype | | | | | | | | |
|---|---|---|---|---|---|---|---|---|
| CGTGTTTCGA | — | — | — | — | — | — | — | |
| CGTGTTTCGG | — | — | — | — | — | — | — | |
| CGTGTTTTAA | — | — | — | — | — | — | — | |
| CGTGTTTTAG | — | — | — | — | — | — | — | 1.5% |
| CGTGTTTTGG | 0.4% | 1.0% | 2.29 | 0.034 | 1.1% | 2.55 | 0.093 | 1.2% |
| TATGTCGTAA | 5.3% | 4.7% | 0.89 | 0.404 | 5.1% | 0.97 | 0.891 | 4.9% |
| TATGTCGTAG | 0.7% | 0.7% | 1.04 | 0.927 | 1.4% | 2.06 | 0.153 | — |
| TGTGCCGCGG | 5.9% | 5.6% | 0.95 | 0.730 | 5.1% | 0.88 | 0.537 | 5.0% |
| TGTGCCGTAA | 7.9% | 9.2% | 1.18 | 0.139 | 8.6% | 1.11 | 0.555 | 11.1% |
| TGTGCCGTAG | 3.1% | 2.4% | 0.74 | 0.159 | 3.2% | 0.99 | 0.963 | 1.9% |

| | Philadelphia: European Americans | | | | Philadelphia: African-Americans | | | |
|---|---|---|---|---|---|---|---|---|
| | All MI patients (728) | | | Ctrl (127) | All MI patients (105) | | | |
| Haplotype | Frq | RR | P-val | Frq | Frq | RR | P-val | |
| CATGTCGTAA | — | — | — | — | — | — | — | |
| CGCGTCGCAG | — | — | — | — | — | — | — | |
| CGCGTCGCGG | — | — | — | 4.8% | 2.8% | 0.56 | 0.368 | |
| CGCGTCGTAG | — | — | — | 3.0% | 1.8% | 0.58 | 0.522 | |
| CGCGTTGCAG | — | — | — | — | — | — | — | |
| CGCGTTGCGG | — | — | — | 3.5% | 0.0% | 0.00 | 0.033 | |
| CGCGTTGTAA | 1.3% | 0.58 | 0.125 | 0.2% | 1.3% | 7.64 | 0.393 | |
| CGCGTTGTAG | 4.8% | 0.72 | 0.093 | 5.1% | 7.7% | 1.55 | 0.366 | |
| CGCGTTGTGG | — | — | — | — | — | — | — | |
| CGCGTTTTAA | — | — | — | — | — | — | — | |
| CGTATCTCGA | — | — | — | 3.4% | 2.2% | 0.63 | 0.470 | |
| CGTATCTCGG | — | — | — | — | — | — | — | |
| CGTATCTTAG | — | — | — | — | — | — | — | |
| CGTATTGCGG | — | — | — | — | — | — | — | |
| CGTATTGTAG | — | — | — | — | — | — | — | |
| CGTATTTCAG | 1.1% | 2.89 | 0.080 | — | — | — | — | |
| CGTATTTCGA | — | — | — | 1.4% | 1.4% | 1.01 | 0.994 | |
| CGTATTTCGG | 18.6% | 1.37 | 0.010 | 1.7% | 10.3% | 6.50 | 0.00013 | |
| CGTATTTTAA | 3.0% | 1.19 | 0.549 | 2.2% | 1.5% | 0.69 | 0.704 | |
| CGTATTTTAG | 36.4% | 0.84 | 0.049 | 14.4% | 22.7% | 1.74 | 0.030 | |
| CGTGTCGTAG | — | — | — | — | — | — | — | |
| CGTGTCGTGG | — | — | — | — | — | — | — | |
| CGTGTCTCAG | — | — | — | 0.5% | 1.4% | 2.79 | 0.391 | |
| CGTGTCTCGA | — | — | — | — | — | — | — | |
| CGTGTCTCGG | — | — | — | 3.6% | 2.9% | 0.79 | 0.757 | |

TABLE 51-continued

| | | | | | | | |
|---|---|---|---|---|---|---|---|
| CGTGTCTTAA | — | — | — | 3.5% | 0.6% | 0.18 | 0.049 |
| CGTGTCTTAG | 2.7% | 1.75 | 0.085 | 19.9% | 10.5% | 0.48 | 0.014 |
| CGTGTCTTGA | — | — | — | — | — | — | — |
| CGTGTCTTGG | 2.3% | 1.24 | 0.493 | 6.3% | 6.9% | 1.10 | 0.814 |
| CGTGTTGTAA | — | — | — | — | — | — | — |
| CGTGTTTCAG | — | — | — | 0.0% | 2.5% | 17338 | 0.009 |
| CGTGTTTCGA | — | — | — | — | — | — | — |
| CGTGTTTCGG | — | — | — | 2.1% | 3.7% | 1.84 | 0.504 |
| CGTGTTTTAA | — | — | — | — | — | — | — |
| CGTGTTTTAG | 0.7% | 0.47 | 0.111 | 18.1% | 10.7% | 0.54 | 0.045 |
| CGTGTTTTGG | 1.7% | 1.40 | 0.370 | 1.1% | 0.0% | 0.00 | 0.194 |
| TATGTCGTAA | 6.0% | 1.23 | 0.289 | 0.8% | 1.9% | 2.47 | 0.282 |
| TATGTCGTAG | — | — | — | — | — | — | — |
| TGTGCCGCGG | 4.7% | 0.93 | 0.724 | 1.2% | 1.4% | 1.19 | 0.848 |
| TGTGCCGTAA | 9.8% | 0.87 | 0.322 | 1.1% | 0.1% | 0.13 | 0.452 |
| TGTGCCGTAG | 1.8% | 0.92 | 0.829 | 1.7% | 1.2% | 0.73 | 0.732 |

Table 51 shows are all observed haplotypes with frequency greater than 1% in the population controls for each indicated cohort, and the allelic frequency (Frq) in patients and controls (Ctrl). Also shown is the relative risk (RR) and the two sided P-value for the association to MI. The SNPs defining the haplotypes are SG12S16, rs2660880, rs6538697, rs1978331, rs17677715, rs2247570, rs2660898, rs2540482, rs2660845, and rs2540475, respectively. HapK is colored red. All SNPs are reported on the plus strand.

Table 52 shows the frequency of HapK in patients and controls, with the corresponding numbers (n) of subjects (patients/controls), the relative risk (RR), and the P-values, in the Icelandic and American cohorts. The results are shown for European Americans and African Americans, defined by their self reported ethnicity (sre). Within each self-reported group, results are shown for those who have a genetically detected ancestry (gda) of at least 20% European and African, respectively. Further, results adjusted for admixed ancestry in each self-reported group are shown. MI and additional CVD refer to those MI patients who also have either peripheral vascular disease or who have suffered a stroke. Previous history of stroke or peripheral vascular disease was not available for the subjects from Philadelphia. The P-values are two-sided for Icelanders, but one-sided in all the other cases since we are specifically testing the excess of HapK in patients relative to controls:

TABLE 52

The Association of HapK to MI

| | Frequency of HapK | | | |
|---|---|---|---|---|
| Cohorts (n) | Patients | Controls | RR | P-value |
| Icelanders | | | | |
| All MI (1553/863) | 0.113 | 0.104 | 1.1 | 0.36 |
| MI and additional CVD (325/863) | 0.145 | 0.104 | 1.45 | 0.0091 |

TABLE 52-continued

The Association of HapK to MI

| | Frequency of HapK | | | |
|---|---|---|---|---|
| Cohorts (n) | Patients | Controls | RR | P-value |
| European Americans Philadelphia | | | | |
| All MI sre (728/430) | 0.186 | 0.143 | 1.37 | 0.0051 |
| All MI gda (724/430) | 0.186 | 0.143 | 1.37 | 0.0051 |
| All MI admix adj | | | 1.36 | 0.0048 |
| Cleveland | | | | |
| All MI sre (627/792) | 0.166 | 0.151 | 1.12 | 0.15 |
| All MI gda (626/792) | 0.166 | 0.151 | 1.11 | 0.16 |
| All MI admix adj | | | 1.12 | 0.15 |
| MI and additional CVD sre (144/792) | 0.193 | 0.151 | 1.34 | 0.046 |
| MI and additional CVD admix adj | | | 1.34 | 0.044 |
| Atlanta | | | | |
| All MI sre (236/553) | 0.135 | 0.143 | 0.94 | 0.64 |
| All MI gda (236/553) | 0.135 | 0.143 | 0.94 | 0.64 |
| All MI admix adj | | | 0.94 | 0.63 |
| MI and additional CVD sre (39/553) | 0.173 | 0.143 | 1.25 | 0.25 |
| MI and additional CVD admix adj | | | 1.24 | 0.26 |
| African Americans Philadelphia | | | | |
| All MI sre (105/127) | 0.103 | 0.017 | 6.5 | 0.000067 |
| All MI gda (100/126) | 0.104 | 0.018 | 6.45 | 0.000088 |
| All MI admix adj | | | 6.34 | 0.00010 |
| Cleveland | | | | |
| All MI sre (53/111) | 0.122 | 0.072 | 1.78 | 0.11 |
| All MI gda (52/111) | 0.112 | 0.072 | 1.61 | 0.17 |

TABLE 52-continued

The Association of HapK to MI

|  | Frequency of HapK | | | |
| --- | --- | --- | --- | --- |
| Cohorts (n) | Patients | Controls | RR | P-value |
| All MI admix adj |  |  | 1.75 | 0.11 |
| MI and additional CVD sre (13/111) | 0.152 | 0.072 | 2.31 | 0.14 |
| MI and additional CVD admix adj |  |  | 2.27 | 0.16 |
| Atlanta |  |  |  |  |
| All MI sre (39/149) | 0.075 | 0.015 | 5.21 | 0.018 |
| All MI gda (38/146) | 0.071 | 0.016 | 4.71 | 0.025 |
| All MI admix adj |  |  | 5.08 | 0.019 |
| MI and additional CVD sre (8/149) | 0.202 | 0.015 | 16.36 | 0.0039 |
| MI and additional CVD admix adj |  |  | 16.67 | 0.0035 |

EXAMPLE 21

HapK Identifies Ethnic-specific Higher Risk of Myocardial Infarction

Further analysis of the replication study presented in Example 18 on three independent MI cohorts from the United States revealed that HapK is associated with high risk of MI in African American subjects. All three cohorts contained both self-reported European Americans and African Americans (see Table 52 above for breakdown), who were analyzed separately. Table 52 shows association results for HapK, in each of the US cohorts. P-values reported for all the replication analyses are one-sided, as we tested only HapK for increased risk. An excess of HapK was detected in European American patients from Philadelphia (RR=1.37, P=0.0051) and Cleveland (RR=1.12, NS), but not from Atlanta (Table 52). Table 53 shows that an association of HapK to MI in European Americans was replicated both when the three cohorts were simply combined (RR=1.19, P=0.006) and when a Mantel-Haenszel-like analysis (Falush et al., *Genetics* 164, 1567-87, 2003) was performed to adjust for differences in HapK frequency between controls in the three cohorts (RR=1.16, P=0.019). Interestingly, as in Iceland, the risk of HapK was greater in the subgroup of MI patients that had a history of stroke or peripheral vascular disease (Table 52), with the combined cohort adjusted analysis yielding a RR of 1.31 (P=0.037, Table 53).

The results displayed in Table 53 describe the association of HapK to MI in combined groups of self-reported European and African Americans respectively, from Philadelphia, Cleveland, and Atlanta. The haplotype frequencies, the resulting relative risk (RR), and the P-values are shown, first, without any population adjustment, second, adjusting for different cohort or population frequencies (coh adj), and third, adjusting for the admixture of African and European ancestries within each ethnic group (admix adj). All P-values are one-sided. PAR is the population attributable risk. For the severe phenotype MI and additional CVD, the data for only the Cleveland and Atlanta cohorts were combined, as this information was not available for the subjects from Philadelphia. For Icelanders and the European Americans, instead of using all 10 SNPs of HapK, essentially the same association results could be obtained using 5 SNPs: SG12S25 (rs1978331), SG12S26 (rs17677715), SG12S143 (rs2540482), SG12S144 (rs2660845) and SG12S221 (rs2540475). For the African American Americans, because of the complications of admixture, in addition to the 5 SNPs mentioned it is preferred to add another 2 SNPs: SG12S100 (rs2247570) and SG12S25 (rs2660898) to measure HapK

TABLE 53

The association of HapK to MI in combined American cohorts

|  | Frequency of HapK | | | | |
| --- | --- | --- | --- | --- | --- |
| Ethnic groups (n) | Patients | Controls | RR (95% CI) | P-value | PAR |
| European Americans |  |  |  |  |  |
| All MI (1591/1775) | 0.171 | 0.148 | 1.19 (1.04, 1.36) | 0.006 |  |
| All MI coh adj |  |  | 1.16 (1.01, 1.34) | 0.019 |  |
| All MI coh adj, admix adj |  |  | 1.16 (1.01, 1.33) | 0.017 | 0.046 |
| MI and additional CVD (183/1345)[b] | 0.192 | 0.15 | 1.35 (1.00, 1.81) | 0.026 |  |
| MI and additional CVD coh adj |  |  | 1.31 (0.97, 1.78) | 0.037 |  |
| MI and additional CVD coh adj, admix adj |  |  | 1.32 (0.98, 1.78) | 0.035 | 0.089 |
| African Americans |  |  |  |  |  |
| All MI (197/387) | 0.105 | 0.032 | 3.52 (1.96, 6.29) | 0.000012 |  |
| All MI coh adj |  |  | 3.57 (1.94, 6.57) | 0.000022 |  |
| All MI coh adj, admix adj |  |  | 3.50 (1.90, 6.43) | 0.000029 | 0.144 |
| MI and additional CVD (21/260)[b] | 0.176 | 0.041 | 4.94 (1.58, 15.43) | 0.003 |  |
| MI and additional CVD coh adj |  |  | 4.39 (1.32, 14.64) | 0.008 |  |
| MI and additional CVD coh adj, admix adj |  |  | 4.17 (1.21, 14.30) | 0.012 | 0.219 |

Strikingly, while HapK is less frequent in the general population of African Americans (Table 52), its association to MI was much stronger in this group, with the RR estimated as 6.50, 1.78, and 5.21 for the cohorts from Philadelphia, Cleveland and Atlanta, respectively (Table 52). The estimated RR in Cleveland is substantially less than in the other two cohorts mainly because the control frequency of HapK is higher there. The RR conferred by HapK in the combined group of all African Americans with cohort adjustment was estimated to be 3.57 (P=0.000022). Its confidence interval did not overlap with that of the European Americans (Table 53), demonstrating that RRs of HapK in these two groups are significantly different (P<0.001).

As HapK is much more frequent in European than African Americans, the possibility existed that the greater RR of MI in African Americans is in part attributable to greater European ancestry in patients than in controls. This could be caused either by a bias in data collection (e.g. differences in the recruitment of the patient and control groups), or because European ancestry is by itself a risk factor for MI in African Americans or a close correlate of such a risk factor.

To investigate this further, a set of 75 unlinked microsatellite markers was used to genetically estimate ancestry of the study cohorts from all thee US cohorts, 364 Icelanders and the 90 Nigerian Yorubans used in the HapMap project (The International HapMap Project. *Nature* 426, 789-96, 2003) The unlinked microsatellite markers were selected from about 2000 microsatellites genotyped in a previously described multi-ethnic cohort of 35 European Americans, 88 African Americans, 34 Chinese, and 29 Mexican Americans (Smith et al. *Am J Hum Genet* 74, 1001-13,2004). The microsatellite markers used in this analysis are set out in Table 54. The selected set of microsatellite markers showed the most significant differences between the European Americans, African Americans, and Asians, and also had good quality and yield. The markers were tested in 364 Icelanders, 35 European Americans and 88 African Americans. The markers in bold were used by Tang et al. (*Am. J. Hum. Gen.* 76: 268-75, 2005) to determine ethnicity and are described at the Marshfield Clinic Research Foundation web site (Screening Set 8).

The allele numbers set out in Table 54 refer to microsatellite alleles. The CEPH sample (Center d'Etudes du Polymorphisme Humain, genomics repository) was used as a reference, the lower allele of each microsatellite in this sample is set at 0 and all other alleles in other samples are numbered according in relation to this reference. Thus, allele 1 is 1 bp longer than the lower allele in the CEPH sample, allele 2 is 2 bp longer than the lower allele in the CEPH sample, allele 3 is 3 bp longer than the lower allele in the CEPH sample, allele 4 is 4 bp longer than the lower allele in the CEPH sample. Allele −1 is 1 bp shorter than the lower allele in the CEPH sample, allele −2 is 2 bp shorter than the lower allele in the CEPH sample, and so on.

TABLE 54

Microsatellite markers used for the evaluation of the European and African ancestry

| Chrom | Marker | Allele | frq. Icelanders | frq, Eur. Am. | frq. Affr. Am. |
|---|---|---|---|---|---|
| C01 | D1S493 | 0 | 0.176 | 0.206 | 0.465 |
| C01 | D1S493 | −2 | 0.117 | 0.074 | 0.116 |
| C01 | D1S493 | 2 | 0.041 | 0.074 | 0.093 |
| C01 | D1S493 | −4 | 0.004 | 0.000 | 0.006 |
| C01 | D1S493 | 4 | 0.651 | 0.618 | 0.215 |
| C01 | D1S493 | 6 | 0.011 | 0.029 | 0.105 |
| C01 | D1S2866 | 0 | 0.563 | 0.636 | 0.163 |
| C01 | D1S2866 | −10 | 0.000 | 0.000 | 0.006 |
| C01 | D1S2866 | −1 | 0.009 | 0.000 | 0.000 |
| C01 | D1S2866 | −16 | 0.000 | 0.000 | 0.047 |
| C01 | D1S2866 | −2 | 0.289 | 0.258 | 0.215 |
| C01 | D1S2866 | 2 | 0.025 | 0.046 | 0.035 |
| C01 | D1S2866 | −4 | 0.049 | 0.061 | 0.308 |
| C01 | D1S2866 | 4 | 0.009 | 0.000 | 0.012 |
| C01 | D1S2866 | −6 | 0.055 | 0.000 | 0.204 |
| C01 | D1S2866 | 6 | 0.002 | 0.000 | 0.006 |
| C01 | D1S2866 | 8 | 0.000 | 0.000 | 0.006 |
| C01 | D1S2630 | 0 | 0.694 | 0.743 | 0.238 |
| C01 | D1S2630 | 10 | 0.000 | 0.000 | 0.035 |
| C01 | D1S2630 | 12 | 0.021 | 0.014 | 0.012 |
| C01 | D1S2630 | 2 | 0.000 | 0.000 | 0.058 |
| C01 | D1S2630 | 4 | 0.039 | 0.014 | 0.116 |
| C01 | D1S2630 | 6 | 0.216 | 0.186 | 0.238 |
| C01 | D1S2630 | 8 | 0.030 | 0.043 | 0.302 |
| C01 | D1S466 | 0 | 0.209 | 0.086 | 0.084 |

TABLE 54-continued

Microsatellite markers used for the evaluation of the European and African ancestry

| Chrom | Marker | Allele | frq. Icelanders | frq, Eur. Am. | frq. Affr. Am. |
|---|---|---|---|---|---|
| C01 | D1S466 | 10 | 0.007 | 0.014 | 0.042 |
| C01 | D1S466 | −12 | 0.000 | 0.000 | 0.006 |
| C01 | D1S466 | 12 | 0.000 | 0.000 | 0.018 |
| C01 | D1S466 | 14 | 0.005 | 0.014 | 0.006 |
| C01 | D1S466 | 16 | 0.000 | 0.000 | 0.006 |
| C01 | D1S466 | −2 | 0.021 | 0.029 | 0.000 |
| C01 | D1S466 | 2 | 0.045 | 0.014 | 0.259 |
| C01 | D1S466 | −22 | 0.003 | 0.000 | 0.000 |
| C01 | D1S466 | −4 | 0.420 | 0.543 | 0.066 |
| C01 | D1S466 | 4 | 0.144 | 0.157 | 0.235 |
| C01 | D1S466 | −6 | 0.007 | 0.029 | 0.145 |
| C01 | D1S466 | 6 | 0.080 | 0.057 | 0.060 |
| C01 | D1S466 | −8 | 0.005 | 0.000 | 0.018 |
| C01 | D1S466 | 8 | 0.055 | 0.057 | 0.054 |
| C01 | D1S1660 | 0 | 0.201 | 0.229 | 0.294 |
| C01 | D1S1660 | 12 | 0.170 | 0.229 | 0.118 |
| C01 | D1S1660 | 16 | 0.021 | 0.029 | 0.053 |
| C01 | D1S1660 | 20 | 0.002 | 0.000 | 0.006 |
| C01 | D1S1660 | −4 | 0.050 | 0.029 | 0.100 |
| C01 | D1S1660 | 4 | 0.251 | 0.186 | 0.177 |
| C01 | D1S1660 | −8 | 0.010 | 0.000 | 0.135 |
| C01 | D1S1660 | 8 | 0.296 | 0.300 | 0.118 |
| C01 | D1S2847 | 0 | 0.685 | 0.661 | 0.386 |
| C01 | D1S2847 | −2 | 0.030 | 0.065 | 0.048 |
| C01 | D1S2847 | 2 | 0.050 | 0.032 | 0.006 |
| C01 | D1S2847 | −4 | 0.016 | 0.000 | 0.386 |
| C01 | D1S2847 | 4 | 0.000 | 0.016 | 0.000 |
| C01 | D1S2847 | −6 | 0.220 | 0.226 | 0.175 |
| C02 | D2S1400 | 0 | 0.272 | 0.386 | 0.114 |
| C02 | D2S1400 | 12 | 0.000 | 0.000 | 0.102 |
| C02 | D2S1400 | 16 | 0.000 | 0.000 | 0.011 |
| C02 | D2S1400 | 20 | 0.014 | 0.000 | 0.051 |
| C02 | D2S1400 | 24 | 0.000 | 0.000 | 0.068 |
| C02 | D2S1400 | 28 | 0.000 | 0.000 | 0.051 |
| C02 | D2S1400 | 32 | 0.000 | 0.000 | 0.011 |
| C02 | D2S1400 | 36 | 0.000 | 0.000 | 0.006 |
| C02 | D2S1400 | −4 | 0.301 | 0.329 | 0.307 |
| C02 | D2S1400 | 4 | 0.007 | 0.000 | 0.074 |
| C02 | D2S1400 | −8 | 0.403 | 0.286 | 0.074 |
| C02 | D2S1400 | 8 | 0.003 | 0.000 | 0.131 |
| C02 | D2S166 | 0 | 0.587 | 0.618 | 0.244 |
| C02 | D2S166 | −14 | 0.006 | 0.000 | 0.000 |
| C02 | D2S166 | −2 | 0.112 | 0.162 | 0.097 |
| C02 | D2S166 | 2 | 0.190 | 0.118 | 0.148 |
| C02 | D2S166 | −4 | 0.003 | 0.000 | 0.011 |
| C02 | D2S166 | 4 | 0.101 | 0.103 | 0.386 |
| C02 | D2S166 | 6 | 0.001 | 0.000 | 0.091 |
| C02 | D2S166 | 8 | 0.000 | 0.000 | 0.023 |
| C02 | D2S1777 | 0 | 0.618 | 0.583 | 0.319 |
| C02 | D2S1777 | −12 | 0.000 | 0.000 | 0.007 |
| C02 | D2S1777 | 12 | 0.007 | 0.000 | 0.174 |
| C02 | D2S1777 | 16 | 0.000 | 0.000 | 0.076 |
| C02 | D2S1777 | −20 | 0.002 | 0.000 | 0.000 |
| C02 | D2S1777 | −4 | 0.094 | 0.083 | 0.090 |
| C02 | D2S1777 | 4 | 0.202 | 0.217 | 0.083 |
| C02 | D2S1777 | −8 | 0.002 | 0.000 | 0.014 |
| C02 | D2S1777 | 8 | 0.076 | 0.117 | 0.236 |
| C02 | D2S2972 | 0 | 0.033 | 0.063 | 0.220 |
| C02 | D2S2972 | −12 | 0.000 | 0.000 | 0.073 |
| C02 | D2S2972 | 12 | 0.170 | 0.094 | 0.043 |
| C02 | D2S2972 | −16 | 0.000 | 0.000 | 0.006 |
| C02 | D2S2972 | 16 | 0.120 | 0.125 | 0.006 |
| C02 | D2S2972 | 20 | 0.014 | 0.031 | 0.012 |
| C02 | D2S2972 | 24 | 0.004 | 0.000 | 0.000 |
| C02 | D2S2972 | −4 | 0.000 | 0.000 | 0.055 |
| C02 | D2S2972 | 4 | 0.426 | 0.453 | 0.396 |
| C02 | D2S2972 | −8 | 0.001 | 0.016 | 0.092 |
| C02 | D2S2972 | 8 | 0.2 | 0.219 | 0.098 |
| C02 | D2S1353 | 0 | 0.218 | 0.343 | 0.163 |
| C02 | D2S1353 | −12 | 0.103 | 0.114 | 0.064 |
| C02 | D2S1353 | 12 | 0.004 | 0.000 | 0.006 |
| C02 | D2S1353 | −15 | 0.003 | 0.000 | 0.006 |
| C02 | D2S1353 | −3 | 0.214 | 0.186 | 0.204 |
| C02 | D2S1353 | 3 | 0.127 | 0.057 | 0.070 |

TABLE 54-continued

Microsatellite markers used for the evaluation of the European and African ancestry

| Chrom | Marker | Allele | frq. Icelanders | frq, Eur. Am. | frq. Affr. Am. |
|---|---|---|---|---|---|
| C02 | D2S1353 | −6 | 0.207 | 0.200 | 0.366 |
| C02 | D2S1353 | 6 | 0.057 | 0.057 | 0.017 |
| C02 | D2S1353 | −9 | 0.034 | 0.000 | 0.070 |
| C02 | D2S1353 | 9 | 0.034 | 0.043 | 0.041 |
| C02 | D2S125 | 0 | 0.278 | 0.258 | 0.222 |
| C02 | D2S125 | −10 | 0.000 | 0.000 | 0.019 |
| C02 | D2S125 | 10 | 0.001 | 0.030 | 0.000 |
| C02 | D2S125 | −2 | 0.106 | 0.136 | 0.093 |
| C02 | D2S125 | 2 | 0.100 | 0.091 | 0.210 |
| C02 | D2S125 | −4 | 0.156 | 0.121 | 0.210 |
| C02 | D2S125 | 4 | 0.034 | 0.046 | 0.043 |
| C02 | D2S125 | −6 | 0.192 | 0.197 | 0.117 |
| C02 | D2S125 | 6 | 0.108 | 0.106 | 0.056 |
| C02 | D2S125 | −8 | 0.001 | 0.015 | 0.025 |
| C02 | D2S125 | 8 | 0.023 | 0.000 | 0.006 |
| C03 | D3S4559 | 0 | 0.096 | 0.167 | 0.059 |
| C03 | D3S4559 | −2 | 0.385 | 0.300 | 0.294 |
| C03 | D3S4559 | 2 | 0.004 | 0.000 | 0.279 |
| C03 | D3S4559 | −4 | 0.037 | 0.033 | 0.221 |
| C03 | D3S4559 | 4 | 0.474 | 0.500 | 0.132 |
| C03 | D3S4559 | 6 | 0.004 | 0.000 | 0.015 |
| C03 | D3S1515 | 0 | 0.528 | 0.414 | 0.802 |
| C03 | D3S1515 | 2 | 0.468 | 0.586 | 0.116 |
| C03 | D3S1515 | 4 | 0.003 | 0.000 | 0.000 |
| C03 | D3S1515 | 6 | 0.001 | 0.000 | 0.000 |
| C03 | D3S1515 | 8 | 0.000 | 0.000 | 0.081 |
| C03 | D3S1583 | 0 | 0.765 | 0.843 | 0.155 |
| C03 | D3S1583 | 10 | 0.000 | 0.000 | 0.069 |
| C03 | D3S1583 | 12 | 0.016 | 0.000 | 0.098 |
| C03 | D3S1583 | 14 | 0.005 | 0.014 | 0.035 |
| C03 | D3S1583 | 16 | 0.029 | 0.000 | 0.218 |
| C03 | D3S1583 | 18 | 0.045 | 0.014 | 0.149 |
| C03 | D3S1583 | 20 | 0.071 | 0.057 | 0.092 |
| C03 | D3S1583 | 22 | 0.003 | 0.014 | 0.081 |
| C03 | D3S1583 | 2 | 0.022 | 0.014 | 0.006 |
| C03 | D3S1583 | 24 | 0.026 | 0.014 | 0.075 |
| C03 | D3S1583 | 26 | 0.017 | 0.029 | 0.023 |
| C03 | D3S1583 | 28 | 0.002 | 0.000 | 0.000 |
| C03 | D3S3653 | 0 | 0.413 | 0.397 | 0.103 |
| C03 | D3S3653 | 10 | 0.001 | 0.015 | 0.006 |
| C03 | D3S3653 | 14 | 0.000 | 0.000 | 0.017 |
| C03 | D3S3653 | −2 | 0.017 | 0.000 | 0.006 |
| C03 | D3S3653 | 2 | 0.361 | 0.412 | 0.247 |
| C03 | D3S3653 | −4 | 0.001 | 0.000 | 0.000 |
| C03 | D3S3653 | 4 | 0.134 | 0.103 | 0.316 |
| C03 | D3S3653 | 6 | 0.023 | 0.000 | 0.201 |
| C03 | D3S3653 | 8 | 0.050 | 0.074 | 0.103 |
| C03 | D3S1276 | 0 | 0.371 | 0.288 | 0.361 |
| C03 | D3S1276 | −10 | 0.000 | 0.000 | 0.017 |
| C03 | D3S1276 | 10 | 0.000 | 0.000 | 0.017 |
| C03 | D3S1276 | 12 | 0.000 | 0.000 | 0.017 |
| C03 | D3S1276 | −2 | 0.010 | 0.046 | 0.017 |
| C03 | D3S1276 | 2 | 0.403 | 0.455 | 0.128 |
| C03 | D3S1276 | −4 | 0.044 | 0.015 | 0.035 |
| C03 | D3S1276 | 4 | 0.112 | 0.121 | 0.099 |
| C03 | D3S1276 | 6 | 0.033 | 0.046 | 0.041 |
| C03 | D3S1276 | −8 | 0.000 | 0.000 | 0.180 |
| C03 | D3S1276 | 8 | 0.027 | 0.030 | 0.087 |
| C03 | D3S3045 | 0 | 0.291 | 0.258 | 0.226 |
| C03 | D3S3045 | −12 | 0.064 | 0.065 | 0.043 |
| C03 | D3S3045 | 12 | 0.000 | 0.016 | 0.061 |
| C03 | D3S3045 | −16 | 0.106 | 0.161 | 0.049 |
| C03 | D3S3045 | 16 | 0.003 | 0.000 | 0.000 |
| C03 | D3S3045 | −4 | 0.204 | 0.194 | 0.220 |
| C03 | D3S3045 | 4 | 0.175 | 0.242 | 0.281 |
| C03 | D3S3045 | −8 | 0.105 | 0.048 | 0.031 |
| C03 | D3S3045 | 8 | 0.051 | 0.016 | 0.092 |
| C03 | D3S4011 | 0 | 0.858 | 0.829 | 0.190 |
| C03 | D3S4011 | 3 | 0.001 | 0.000 | 0.017 |
| C03 | D3S4011 | 6 | 0.138 | 0.157 | 0.776 |
| C03 | D3S4011 | 7 | 0.000 | 0.000 | 0.017 |
| C03 | D3S4011 | 9 | 0.003 | 0.014 | 0.000 |
| C04 | D4S403 | 0 | 0.238 | 0.186 | 0.035 |
| C04 | D4S403 | 10 | 0.407 | 0.386 | 0.273 |
| C04 | D4S403 | 12 | 0.013 | 0.000 | 0.099 |
| C04 | D4S403 | 14 | 0.069 | 0.086 | 0.023 |
| C04 | D4S403 | 16 | 0.002 | 0.000 | 0.017 |
| C04 | D4S403 | 18 | 0.000 | 0.000 | 0.023 |
| C04 | D4S403 | 2 | 0.040 | 0.014 | 0.023 |
| C04 | D4S403 | −4 | 0.000 | 0.000 | 0.006 |
| C04 | D4S403 | 4 | 0.021 | 0.043 | 0.140 |
| C04 | D4S403 | 6 | 0.054 | 0.114 | 0.122 |
| C04 | D4S403 | 8 | 0.156 | 0.171 | 0.238 |
| C04 | D4S396 | 0 | 0.549 | 0.529 | 0.364 |
| C04 | D4S396 | 10 | 0.004 | 0.014 | 0.000 |
| C04 | D4S396 | −2 | 0.012 | 0.000 | 0.006 |
| C04 | D4S396 | 2 | 0.001 | 0.000 | 0.358 |
| C04 | D4S396 | −4 | 0.001 | 0.000 | 0.000 |
| C04 | D4S396 | 4 | 0.007 | 0.014 | 0.040 |
| C04 | D4S396 | 6 | 0.367 | 0.343 | 0.227 |
| C04 | D4S396 | 8 | 0.058 | 0.100 | 0.006 |
| C04 | D4S2460 | 0 | 0.435 | 0.343 | 0.296 |
| C04 | D4S2460 | −10 | 0.000 | 0.000 | 0.006 |
| C04 | D4S2460 | −2 | 0.032 | 0.000 | 0.347 |
| C04 | D4S2460 | 2 | 0.245 | 0.286 | 0.142 |
| C04 | D4S2460 | −4 | 0.215 | 0.300 | 0.102 |
| C04 | D4S2460 | 4 | 0.052 | 0.057 | 0.063 |
| C04 | D4S2460 | −6 | 0.002 | 0.014 | 0.028 |
| C04 | D4S2460 | −8 | 0.019 | 0.000 | 0.017 |
| C04 | D4S2913 | 0 | 0.177 | 0.129 | 0.068 |
| C04 | D4S2913 | −10 | 0.035 | 0.043 | 0.011 |
| C04 | D4S2913 | 10 | 0.002 | 0.014 | 0.006 |
| C04 | D4S2913 | −2 | 0.021 | 0.029 | 0.449 |
| C04 | D4S2913 | 2 | 0.322 | 0.286 | 0.097 |
| C04 | D4S2913 | −4 | 0.034 | 0.014 | 0.040 |
| C04 | D4S2913 | 4 | 0.027 | 0.029 | 0.046 |
| C04 | D4S2913 | −6 | 0.341 | 0.414 | 0.261 |
| C04 | D4S2913 | 6 | 0.043 | 0.043 | 0.006 |
| C04 | D4S2913 | −8 | 0.000 | 0.000 | 0.011 |
| C04 | D4S2913 | 8 | 0.000 | 0.000 | 0.011 |
| C04 | D4S1579 | 0 | 0.508 | 0.571 | 0.506 |
| C04 | D4S1579 | 10 | 0.045 | 0.086 | 0.006 |
| C04 | D4S1579 | 12 | 0.030 | 0.014 | 0.006 |
| C04 | D4S1579 | 14 | 0.000 | 0.014 | 0.006 |
| C04 | D4S1579 | −2 | 0.001 | 0.000 | 0.031 |
| C04 | D4S1579 | 2 | 0.035 | 0.029 | 0.306 |
| C04 | D4S1579 | −4 | 0.001 | 0.000 | 0.000 |
| C04 | D4S1579 | 4 | 0.018 | 0.014 | 0.075 |
| C04 | D4S1579 | −6 | 0.013 | 0.000 | 0.006 |
| C04 | D4S1579 | 6 | 0.058 | 0.057 | 0.019 |
| C04 | D4S1579 | 8 | 0.291 | 0.214 | 0.044 |
| C04 | D4S3014 | 0 | 0.097 | 0.029 | 0.024 |
| C04 | D4S3014 | 10 | 0.000 | 0.000 | 0.113 |
| C04 | D4S3014 | 12 | 0.000 | 0.000 | 0.018 |
| C04 | D4S3014 | 14 | 0.000 | 0.000 | 0.006 |
| C04 | D4S3014 | 16 | 0.000 | 0.000 | 0.024 |
| C04 | D4S3014 | −2 | 0.000 | 0.000 | 0.006 |
| C04 | D4S3014 | 2 | 0.085 | 0.015 | 0.191 |
| C04 | D4S3014 | −4 | 0.077 | 0.118 | 0.101 |
| C04 | D4S3014 | 4 | 0.597 | 0.794 | 0.232 |
| C04 | D4S3014 | −6 | 0.000 | 0.000 | 0.036 |
| C04 | D4S3014 | 6 | 0.136 | 0.015 | 0.196 |
| C04 | D4S3014 | 8 | 0.009 | 0.029 | 0.054 |
| C04 | D4S408 | 0 | 0.161 | 0.167 | 0.262 |
| C04 | D4S408 | 10 | 0.004 | 0.000 | 0.006 |
| C04 | D4S408 | 12 | 0.169 | 0.197 | 0.066 |
| C04 | D4S408 | 14 | 0.011 | 0.015 | 0.000 |
| C04 | D4S408 | 16 | 0.000 | 0.015 | 0.000 |
| C04 | D4S408 | −2 | 0.389 | 0.424 | 0.143 |
| C04 | D4S408 | 2 | 0.176 | 0.121 | 0.268 |
| C04 | D4S408 | −4 | 0.000 | 0.000 | 0.036 |
| C04 | D4S408 | 4 | 0.079 | 0.061 | 0.155 |
| C04 | D4S408 | 6 | 0.010 | 0.000 | 0.036 |
| C04 | D4S408 | 8 | 0.001 | 0.000 | 0.030 |
| C05 | D5S1967 | 0 | 0.093 | 0.157 | 0.063 |
| C05 | D5S1967 | 10 | 0.000 | 0.000 | 0.006 |
| C05 | D5S1967 | 2 | 0.032 | 0.000 | 0.210 |
| C05 | D5S1967 | 4 | 0.010 | 0.000 | 0.091 |

TABLE 54-continued

Microsatellite markers used for the evaluation of the European and African ancestry

| Chrom | Marker | Allele | frq. Icelanders | frq, Eur. Am. | frq. Affr. Am. |
|---|---|---|---|---|---|
| C05 | D5S1967 | 6 | 0.828 | 0.786 | 0.438 |
| C05 | D5S1967 | 8 | 0.038 | 0.057 | 0.193 |
| C05 | D5S1725 | 0 | 0.049 | 0.059 | 0.082 |
| C05 | D5S1725 | −12 | 0.013 | 0.000 | 0.000 |
| C05 | D5S1725 | 12 | 0.105 | 0.147 | 0.153 |
| C05 | D5S1725 | 16 | 0.019 | 0.000 | 0.006 |
| C05 | D5S1725 | −4 | 0.037 | 0.074 | 0.071 |
| C05 | D5S1725 | 4 | 0.166 | 0.191 | 0.271 |
| C05 | D5S1725 | −8 | 0.427 | 0.338 | 0.088 |
| C05 | D5S1725 | 8 | 0.185 | 0.191 | 0.329 |
| C05 | DG5S802 | 0 | 0.651 | 0.729 | 0.227 |
| C05 | DG5S802 | −10 | 0.000 | 0.000 | 0.012 |
| C05 | DG5S802 | 10 | 0.007 | 0.000 | 0.035 |
| C05 | DG5S802 | −12 | 0.000 | 0.014 | 0.000 |
| C05 | DG5S802 | 12 | 0.002 | 0.000 | 0.017 |
| C05 | DG5S802 | 14 | 0.002 | 0.000 | 0.012 |
| C05 | DG5S802 | 16 | 0.000 | 0.000 | 0.006 |
| C05 | DG5S802 | −2 | 0.020 | 0.014 | 0.099 |
| C05 | DG5S802 | 2 | 0.131 | 0.186 | 0.070 |
| C05 | DG5S802 | −4 | 0.002 | 0.000 | 0.012 |
| C05 | DG5S802 | 4 | 0.018 | 0.000 | 0.070 |
| C05 | DG5S802 | −6 | 0.000 | 0.014 | 0.058 |
| C05 | DG5S802 | 6 | 0.153 | 0.014 | 0.047 |
| C05 | DG5S802 | −8 | 0.009 | 0.029 | 0.297 |
| C05 | DG5S802 | 8 | 0.004 | 0.000 | 0.041 |
| C05 | D5S408 | 0 | 0.185 | 0.250 | 0.178 |
| C05 | D5S408 | 10 | 0.174 | 0.162 | 0.190 |
| C05 | D5S408 | 12 | 0.058 | 0.059 | 0.040 |
| C05 | D5S408 | 14 | 0.039 | 0.029 | 0.017 |
| C05 | D5S408 | 16 | 0.010 | 0.015 | 0.046 |
| C05 | D5S408 | 20 | 0.000 | 0.000 | 0.006 |
| C05 | D5S408 | −2 | 0.021 | 0.000 | 0.063 |
| C05 | D5S408 | 2 | 0.011 | 0.015 | 0.012 |
| C05 | D5S408 | 22 | 0.000 | 0.000 | 0.006 |
| C05 | D5S408 | 4 | 0.008 | 0.000 | 0.012 |
| C05 | D5S408 | 6 | 0.142 | 0.074 | 0.213 |
| C05 | D5S408 | 8 | 0.352 | 0.397 | 0.218 |
| C06 | D6S1017 | 0 | 0.424 | 0.544 | 0.229 |
| C06 | D6S1017 | −12 | 0.000 | 0.000 | 0.247 |
| C06 | D6S1017 | 13 | 0.041 | 0.029 | 0.029 |
| C06 | D6S1017 | 17 | 0.000 | 0.015 | 0.000 |
| C06 | D6S1017 | −4 | 0.001 | 0.000 | 0.077 |
| C06 | D6S1017 | 5 | 0.050 | 0.015 | 0.059 |
| C06 | D6S1017 | −8 | 0.283 | 0.132 | 0.265 |
| C06 | D6S1017 | 9 | 0.200 | 0.265 | 0.094 |
| C06 | D6S405 | 0 | 0.551 | 0.643 | 0.180 |
| C06 | D6S405 | 10 | 0.289 | 0.186 | 0.517 |
| C06 | D6S405 | 12 | 0.022 | 0.014 | 0.087 |
| C06 | D6S405 | 14 | 0.000 | 0.000 | 0.017 |
| C06 | D6S405 | 16 | 0.000 | 0.000 | 0.006 |
| C06 | D6S405 | 2 | 0.002 | 0.000 | 0.006 |
| C06 | D6S405 | −4 | 0.002 | 0.000 | 0.000 |
| C06 | D6S405 | 4 | 0.000 | 0.000 | 0.006 |
| C06 | D6S405 | 6 | 0.000 | 0.000 | 0.006 |
| C06 | D6S405 | 8 | 0.134 | 0.157 | 0.174 |
| C06 | D6S446 | 0 | 0.222 | 0.171 | 0.172 |
| C06 | D6S446 | −2 | 0.433 | 0.557 | 0.506 |
| C06 | D6S446 | 2 | 0.050 | 0.043 | 0.144 |
| C06 | D6S446 | 4 | 0.118 | 0.043 | 0.040 |
| C06 | D6S446 | 6 | 0.143 | 0.157 | 0.132 |
| C06 | D6S446 | 8 | 0.034 | 0.029 | 0.006 |
| C07 | D7S1802 | 0 | 0.310 | 0.329 | 0.302 |
| C07 | D7S1802 | −10 | 0.002 | 0.000 | 0.000 |
| C07 | D7S1802 | −12 | 0.005 | 0.000 | 0.047 |
| C07 | D7S1802 | 12 | 0.014 | 0.014 | 0.023 |
| C07 | D7S1802 | −14 | 0.003 | 0.000 | 0.000 |
| C07 | D7S1802 | 16 | 0.007 | 0.000 | 0.006 |
| C07 | D7S1802 | −4 | 0.337 | 0.471 | 0.209 |
| C07 | D7S1802 | 4 | 0.176 | 0.143 | 0.326 |
| C07 | D7S1802 | −8 | 0.048 | 0.000 | 0.006 |
| C07 | D7S1802 | 8 | 0.098 | 0.043 | 0.081 |
| C07 | D7S559 | 0 | 0.129 | 0.157 | 0.230 |
| C07 | D7S559 | 13 | 0.000 | 0.000 | 0.012 |
| C07 | D7S559 | 14 | 0.000 | 0.000 | 0.006 |
| C07 | D7S559 | 15 | 0.015 | 0.000 | 0.000 |
| C07 | D7S559 | 19 | 0.000 | 0.000 | 0.006 |
| C07 | D7S559 | 20 | 0.000 | 0.000 | 0.006 |
| C07 | D7S559 | 21 | 0.000 | 0.000 | 0.006 |
| C07 | D7S559 | −2 | 0.210 | 0.229 | 0.103 |
| C07 | D7S559 | 2 | 0.290 | 0.329 | 0.305 |
| C07 | D7S559 | 22 | 0.000 | 0.000 | 0.029 |
| C07 | D7S559 | 24 | 0.000 | 0.000 | 0.006 |
| C07 | D7S559 | 26 | 0.000 | 0.000 | 0.052 |
| C07 | D7S559 | −4 | 0.087 | 0.086 | 0.115 |
| C07 | D7S559 | 4 | 0.060 | 0.057 | 0.035 |
| C07 | D7S559 | −6 | 0.162 | 0.086 | 0.040 |
| C07 | D7S559 | 6 | 0.002 | 0.014 | 0.012 |
| C07 | D7S559 | −8 | 0.010 | 0.000 | 0.000 |
| C07 | D7S559 | 8 | 0.035 | 0.043 | 0.040 |
| C08 | DG8S156 | 0 | 0.561 | 0.516 | 0.440 |
| C08 | DG8S156 | 12 | 0.000 | 0.000 | 0.048 |
| C08 | DG8S156 | −3 | 0.000 | 0.000 | 0.006 |
| C08 | DG8S156 | 3 | 0.001 | 0.016 | 0.078 |
| C08 | DG8S156 | −6 | 0.031 | 0.047 | 0.030 |
| C08 | DG8S156 | 6 | 0.386 | 0.375 | 0.295 |
| C08 | DG8S156 | 9 | 0.021 | 0.047 | 0.102 |
| C08 | D8S1719 | 0 | 0.119 | 0.143 | 0.122 |
| C08 | D8S1719 | −2 | 0.757 | 0.786 | 0.256 |
| C08 | D8S1719 | 2 | 0.083 | 0.057 | 0.134 |
| C08 | D8S1719 | −4 | 0.021 | 0.000 | 0.355 |
| C08 | D8S1719 | 4 | 0.020 | 0.014 | 0.029 |
| C08 | D8S1719 | −6 | 0.000 | 0.000 | 0.047 |
| C08 | D8S1719 | 6 | 0.002 | 0.000 | 0.029 |
| C08 | D8S1719 | −8 | 0.000 | 0.000 | 0.017 |
| C08 | D8S1719 | 8 | 0.000 | 0.000 | 0.012 |
| C08 | D8S1831 | 0 | 0.506 | 0.645 | 0.149 |
| C08 | D8S1831 | 10 | 0.076 | 0.065 | 0.081 |
| C08 | D8S1831 | −12 | 0.013 | 0.000 | 0.000 |
| C08 | D8S1831 | 12 | 0.002 | 0.000 | 0.058 |
| C08 | D8S1831 | 14 | 0.002 | 0.000 | 0.006 |
| C08 | D8S1831 | −2 | 0.026 | 0.032 | 0.017 |
| C08 | D8S1831 | 2 | 0.229 | 0.145 | 0.207 |
| C08 | D8S1831 | −4 | 0.002 | 0.016 | 0.000 |
| C08 | D8S1831 | 4 | 0.024 | 0.016 | 0.149 |
| C08 | D8S1831 | 6 | 0.005 | 0.000 | 0.109 |
| C08 | D8S1831 | 8 | 0.116 | 0.081 | 0.224 |
| C08 | D8S1746 | 0 | 0.521 | 0.557 | 0.105 |
| C08 | D8S1746 | 10 | 0.043 | 0.014 | 0.017 |
| C08 | D8S1746 | 12 | 0.003 | 0.000 | 0.006 |
| C08 | D8S1746 | 16 | 0.000 | 0.000 | 0.029 |
| C08 | D8S1746 | 2 | 0.192 | 0.214 | 0.238 |
| C08 | D8S1746 | 4 | 0.178 | 0.171 | 0.151 |
| C08 | D8S1746 | 6 | 0.061 | 0.043 | 0.326 |
| C08 | D8S1746 | 8 | 0.001 | 0.000 | 0.128 |
| C09 | D9S1839 | 0 | 0.507 | 0.614 | 0.192 |
| C09 | D9S1839 | 10 | 0.016 | 0.014 | 0.058 |
| C09 | D9S1839 | 12 | 0.000 | 0.000 | 0.099 |
| C09 | D9S1839 | 14 | 0.000 | 0.000 | 0.076 |
| C09 | D9S1839 | −2 | 0.012 | 0.000 | 0.000 |
| C09 | D9S1839 | 2 | 0.004 | 0.014 | 0.035 |
| C09 | D9S1839 | 22 | 0.003 | 0.000 | 0.000 |
| C09 | D9S1839 | 4 | 0.107 | 0.114 | 0.017 |
| C09 | D9S1839 | 6 | 0.012 | 0.029 | 0.058 |
| C09 | D9S1839 | 8 | 0.339 | 0.214 | 0.459 |
| C09 | D9S1839 | 9 | 0.000 | 0.000 | 0.006 |
| C09 | D9S1777 | 0 | 0.690 | 0.657 | 0.205 |
| C09 | D9S1777 | 10 | 0.011 | 0.000 | 0.011 |
| C09 | D9S1777 | 18 | 0.001 | 0.000 | 0.006 |
| C09 | D9S1777 | −2 | 0.000 | 0.000 | 0.483 |
| C09 | D9S1777 | 2 | 0.204 | 0.200 | 0.011 |
| C09 | D9S1777 | 4 | 0.001 | 0.000 | 0.023 |
| C09 | D9S1777 | 6 | 0.076 | 0.143 | 0.250 |
| C09 | D9S1777 | 8 | 0.013 | 0.000 | 0.011 |
| C09 | D9S1777 | −9 | 0.004 | 0.000 | 0.000 |
| C10 | D10S189 | 0 | 0.434 | 0.543 | 0.358 |
| C10 | D10S189 | 10 | 0.004 | 0.000 | 0.000 |
| C10 | D10S189 | −2 | 0.213 | 0.157 | 0.091 |
| C10 | D10S189 | 2 | 0.004 | 0.000 | 0.102 |

TABLE 54-continued

Microsatellite markers used for the evaluation of the European and African ancestry

| Chrom | Marker | Allele | frq. Icelanders | frq, Eur. Am. | frq. Affr. Am. |
|---|---|---|---|---|---|
| C10 | D10S189 | 4 | 0.224 | 0.229 | 0.398 |
| C10 | D10S189 | 6 | 0.121 | 0.057 | 0.051 |
| C10 | D10S189 | 8 | 0.000 | 0.014 | 0.000 |
| C10 | D10S2327 | 0 | 0.570 | 0.586 | 0.193 |
| C10 | D10S2327 | 12 | 0.124 | 0.157 | 0.296 |
| C10 | D10S2327 | 16 | 0.086 | 0.029 | 0.239 |
| C10 | D10S2327 | 20 | 0.163 | 0.186 | 0.165 |
| C10 | D10S2327 | 24 | 0.019 | 0.014 | 0.046 |
| C10 | D10S2327 | 28 | 0.002 | 0.000 | 0.000 |
| C10 | D10S2327 | 4 | 0.023 | 0.029 | 0.023 |
| C10 | D10S2327 | 8 | 0.015 | 0.000 | 0.040 |
| C10 | D10S1698 | 0 | 0.834 | 0.829 | 0.369 |
| C10 | D10S1698 | 16 | 0.056 | 0.043 | 0.179 |
| C10 | D10S1698 | 18 | 0.000 | 0.000 | 0.018 |
| C10 | D10S1698 | 20 | 0.068 | 0.086 | 0.089 |
| C10 | D10S1698 | 22 | 0.042 | 0.043 | 0.232 |
| C10 | D10S1698 | 24 | 0.000 | 0.000 | 0.054 |
| C10 | D10S1698 | -2 | 0.000 | 0.000 | 0.006 |
| C10 | D10S1698 | 2 | 0.000 | 0.000 | 0.030 |
| C10 | D10S1698 | 4 | 0.000 | 0.000 | 0.024 |
| C10 | D10S212 | 0 | 0.564 | 0.529 | 0.627 |
| C10 | D10S212 | -2 | 0.007 | 0.000 | 0.025 |
| C10 | D10S212 | 2 | 0.062 | 0.044 | 0.101 |
| C10 | D10S212 | -4 | 0.107 | 0.103 | 0.057 |
| C10 | D10S212 | 4 | 0.117 | 0.177 | 0.063 |
| C10 | D10S212 | -6 | 0.112 | 0.132 | 0.063 |
| C10 | D10S212 | 6 | 0.030 | 0.015 | 0.063 |
| C11 | D11S4130 | 0 | 0.343 | 0.343 | 0.171 |
| C11 | D11S4130 | -2 | 0.051 | 0.000 | 0.324 |
| C11 | D11S4130 | 2 | 0.486 | 0.486 | 0.318 |
| C11 | D11S4130 | -4 | 0.119 | 0.171 | 0.114 |
| C11 | D11S4130 | 4 | 0.001 | 0.000 | 0.057 |
| C11 | D11S4130 | 6 | 0.000 | 0.000 | 0.017 |
| C11 | D11S1321 | 0 | 0.509 | 0.529 | 0.128 |
| C11 | D11S1321 | -10 | 0.000 | 0.000 | 0.007 |
| C11 | D11S1321 | 10 | 0.015 | 0.015 | 0.054 |
| C11 | D11S1321 | -2 | 0.000 | 0.000 | 0.047 |
| C11 | D11S1321 | 2 | 0.073 | 0.059 | 0.135 |
| C11 | D11S1321 | 3 | 0.000 | 0.000 | 0.034 |
| C11 | D11S1321 | -4 | 0.000 | 0.000 | 0.061 |
| C11 | D11S1321 | 4 | 0.019 | 0.015 | 0.142 |
| C11 | D11S1321 | 6 | 0.341 | 0.368 | 0.291 |
| C11 | D11S1321 | 8 | 0.043 | 0.015 | 0.101 |
| C11 | D11S4206 | 0 | 0.401 | 0.324 | 0.223 |
| C11 | D11S4206 | -2 | 0.112 | 0.088 | 0.157 |
| C11 | D11S4206 | 2 | 0.280 | 0.397 | 0.054 |
| C11 | D11S4206 | -4 | 0.000 | 0.015 | 0.048 |
| C11 | D11S4206 | 4 | 0.006 | 0.000 | 0.000 |
| C11 | D11S4206 | -6 | 0.029 | 0.015 | 0.012 |
| C11 | D11S4206 | -8 | 0.172 | 0.162 | 0.506 |
| C11 | D11S1320 | 0 | 0.576 | 0.606 | 0.363 |
| C11 | D11S1320 | 10 | 0.000 | 0.000 | 0.006 |
| C11 | D11S1320 | 12 | 0.001 | 0.000 | 0.000 |
| C11 | D11S1320 | -2 | 0.030 | 0.030 | 0.238 |
| C11 | D11S1320 | 2 | 0.060 | 0.061 | 0.054 |
| C11 | D11S1320 | -4 | 0.000 | 0.000 | 0.018 |
| C11 | D11S1320 | 4 | 0.296 | 0.242 | 0.185 |
| C11 | D11S1320 | -6 | 0.010 | 0.000 | 0.000 |
| C11 | D11S1320 | 6 | 0.020 | 0.046 | 0.131 |
| C11 | D11S1320 | 8 | 0.006 | 0.015 | 0.006 |
| C12 | D12S1723 | 0 | 0.082 | 0.100 | 0.392 |
| C12 | D12S1723 | 10 | 0.098 | 0.100 | 0.108 |
| C12 | D12S1723 | 12 | 0.011 | 0.043 | 0.054 |
| C12 | D12S1723 | 14 | 0.000 | 0.000 | 0.024 |
| C12 | D12S1723 | 16 | 0.000 | 0.000 | 0.054 |
| C12 | D12S1723 | 18 | 0.000 | 0.000 | 0.024 |
| C12 | D12S1723 | 20 | 0.000 | 0.000 | 0.042 |
| C12 | D12S1723 | -2 | 0.027 | 0.029 | 0.102 |
| C12 | D12S1723 | 2 | 0.008 | 0.000 | 0.042 |
| C12 | D12S1723 | 22 | 0.000 | 0.000 | 0.012 |
| C12 | D12S1723 | 4 | 0.466 | 0.500 | 0.096 |
| C12 | D12S1723 | 6 | 0.289 | 0.214 | 0.048 |
| C12 | D12S1723 | 8 | 0.018 | 0.014 | 0.000 |
| C13 | D13S894 | 0 | 0.058 | 0.091 | 0.082 |
| C13 | D13S894 | 12 | 0.432 | 0.561 | 0.388 |
| C13 | D13S894 | 16 | 0.155 | 0.121 | 0.141 |
| C13 | D13S894 | 20 | 0.033 | 0.030 | 0.071 |
| C13 | D13S894 | 4 | 0.035 | 0.030 | 0.112 |
| C13 | D13S894 | 7 | 0.006 | 0.000 | 0.000 |
| C13 | D13S894 | 8 | 0.281 | 0.167 | 0.206 |
| C13 | D13S152 | 0 | 0.318 | 0.294 | 0.256 |
| C13 | D13S152 | 10 | 0.161 | 0.074 | 0.091 |
| C13 | D13S152 | 12 | 0.006 | 0.015 | 0.000 |
| C13 | D13S152 | -2 | 0.000 | 0.000 | 0.063 |
| C13 | D13S152 | 2 | 0.050 | 0.074 | 0.125 |
| C13 | D13S152 | -4 | 0.000 | 0.000 | 0.011 |
| C13 | D13S152 | 4 | 0.224 | 0.250 | 0.193 |
| C13 | D13S152 | 6 | 0.116 | 0.191 | 0.193 |
| C13 | D13S152 | 8 | 0.125 | 0.103 | 0.068 |
| C14 | D14S741 | 0 | 0.505 | 0.471 | 0.455 |
| C14 | D14S741 | -12 | 0.012 | 0.029 | 0.080 |
| C14 | D14S741 | -14 | 0.087 | 0.071 | 0.000 |
| C14 | D14S741 | -16 | 0.011 | 0.000 | 0.006 |
| C14 | D14S741 | -4 | 0.194 | 0.243 | 0.273 |
| C14 | D14S741 | 4 | 0.180 | 0.157 | 0.142 |
| C14 | D14S741 | -8 | 0.002 | 0.000 | 0.040 |
| C14 | D14S741 | 8 | 0.011 | 0.029 | 0.006 |
| C14 | D14S588 | 0 | 0.407 | 0.500 | 0.230 |
| C14 | D14S588 | -12 | 0.000 | 0.000 | 0.006 |
| C14 | D14S588 | 13 | 0.086 | 0.029 | 0.029 |
| C14 | D14S588 | 17 | 0.006 | 0.014 | 0.023 |
| C14 | D14S588 | 22 | 0.000 | 0.000 | 0.006 |
| C14 | D14S588 | -4 | 0.226 | 0.200 | 0.172 |
| C14 | D14S588 | 5 | 0.150 | 0.186 | 0.115 |
| C14 | D14S588 | -8 | 0.002 | 0.000 | 0.264 |
| C14 | D14S588 | 9 | 0.124 | 0.071 | 0.155 |
| C14 | D14S617 | 0 | 0.075 | 0.143 | 0.115 |
| C14 | D14S617 | -12 | 0.002 | 0.000 | 0.190 |
| C14 | D14S617 | 12 | 0.274 | 0.257 | 0.218 |
| C14 | D14S617 | 16 | 0.187 | 0.257 | 0.126 |
| C14 | D14S617 | 20 | 0.030 | 0.043 | 0.040 |
| C14 | D14S617 | 24 | 0.005 | 0.043 | 0.006 |
| C14 | D14S617 | -4 | 0.092 | 0.086 | 0.063 |
| C14 | D14S617 | 4 | 0.003 | 0.000 | 0.000 |
| C14 | D14S617 | -8 | 0.273 | 0.143 | 0.161 |
| C14 | D14S617 | 8 | 0.061 | 0.029 | 0.081 |
| C15 | D15S659 | 0 | 0.027 | 0.000 | 0.052 |
| C15 | D15S659 | 12 | 0.048 | 0.086 | 0.035 |
| C15 | D15S659 | 16 | 0.031 | 0.071 | 0.047 |
| C15 | D15S659 | 20 | 0.177 | 0.171 | 0.291 |
| C15 | D15S659 | 24 | 0.191 | 0.157 | 0.297 |
| C15 | D15S659 | 28 | 0.106 | 0.086 | 0.081 |
| C15 | D15S659 | 32 | 0.035 | 0.014 | 0.017 |
| C15 | D15S659 | 36 | 0.001 | 0.000 | 0.012 |
| C15 | D15S659 | -4 | 0.001 | 0.000 | 0.000 |
| C15 | D15S659 | 4 | 0.203 | 0.171 | 0.070 |
| C15 | D15S659 | -8 | 0.000 | 0.000 | 0.006 |
| C15 | D15S659 | 8 | 0.179 | 0.243 | 0.093 |
| C15 | D15S1507 | 0 | 0.375 | 0.429 | 0.247 |
| C15 | D15S1507 | 12 | 0.148 | 0.157 | 0.282 |
| C15 | D15S1507 | 16 | 0.029 | 0.029 | 0.121 |
| C15 | D15S1507 | 20 | 0.002 | 0.000 | 0.006 |
| C15 | D15S1507 | -4 | 0.013 | 0.000 | 0.000 |
| C15 | D15S1507 | 4 | 0.261 | 0.243 | 0.167 |
| C15 | D15S1507 | -8 | 0.000 | 0.000 | 0.017 |
| C15 | D15S1507 | 8 | 0.172 | 0.143 | 0.161 |
| C16 | D16S404 | 0 | 0.161 | 0.191 | 0.213 |
| C16 | D16S404 | -14 | 0.036 | 0.029 | 0.115 |
| C16 | D16S404 | -2 | 0.007 | 0.029 | 0.046 |
| C16 | D16S404 | 2 | 0.230 | 0.265 | 0.086 |
| C16 | D16S404 | -4 | 0.230 | 0.147 | 0.397 |
| C16 | D16S404 | 4 | 0.250 | 0.235 | 0.063 |
| C16 | D16S404 | -6 | 0.014 | 0.015 | 0.029 |
| C16 | D16S404 | 6 | 0.071 | 0.074 | 0.040 |
| C16 | D16S404 | 8 | 0.000 | 0.015 | 0.012 |
| C16 | D16S403 | 0 | 0.117 | 0.186 | 0.256 |
| C16 | D16S403 | -10 | 0.000 | 0.000 | 0.012 |
| C16 | D16S403 | 10 | 0.011 | 0.014 | 0.006 |

TABLE 54-continued

Microsatellite markers used for the evaluation of the European and African ancestry

| Chrom | Marker | Allele | frq. Icelanders | frq, Eur. Am. | frq. Affr. Am. |
|---|---|---|---|---|---|
| C16 | D16S403 | 12 | 0.013 | 0.000 | 0.000 |
| C16 | D16S403 | 14 | 0.004 | 0.000 | 0.000 |
| C16 | D16S403 | 16 | 0.001 | 0.000 | 0.000 |
| C16 | D16S403 | −2 | 0.275 | 0.314 | 0.180 |
| C16 | D16S403 | 2 | 0.133 | 0.171 | 0.308 |
| C16 | D16S403 | −4 | 0.050 | 0.043 | 0.006 |
| C16 | D16S403 | 4 | 0.148 | 0.071 | 0.099 |
| C16 | D16S403 | −6 | 0.053 | 0.014 | 0.012 |
| C16 | D16S403 | 6 | 0.137 | 0.129 | 0.099 |
| C16 | D16S403 | −8 | 0.000 | 0.000 | 0.006 |
| C16 | D16S403 | 8 | 0.058 | 0.057 | 0.017 |
| C16 | D16S3253 | 0 | 0.340 | 0.357 | 0.331 |
| C16 | D16S3253 | −12 | 0.009 | 0.018 | 0.029 |
| C16 | D16S3253 | −16 | 0.008 | 0.018 | 0.221 |
| C16 | D16S3253 | 16 | 0.005 | 0.000 | 0.007 |
| C16 | D16S3253 | −20 | 0.000 | 0.000 | 0.007 |
| C16 | D16S3253 | −4 | 0.100 | 0.232 | 0.052 |
| C16 | D16S3253 | 4 | 0.347 | 0.268 | 0.125 |
| C16 | D16S3253 | −8 | 0.187 | 0.089 | 0.228 |
| C16 | D16S3253 | 8 | 0.005 | 0.018 | 0.000 |
| C17 | D17S745 | 0 | 0.375 | 0.371 | 0.177 |
| C17 | D17S745 | 12 | 0.000 | 0.000 | 0.018 |
| C17 | D17S745 | −2 | 0.001 | 0.014 | 0.218 |
| C17 | D17S745 | 2 | 0.077 | 0.000 | 0.418 |
| C17 | D17S745 | −4 | 0.001 | 0.000 | 0.000 |
| C17 | D17S745 | 4 | 0.518 | 0.614 | 0.171 |
| C17 | D17S745 | 6 | 0.027 | 0.000 | 0.000 |
| C17 | D17S1303 | 0 | 0.191 | 0.150 | 0.150 |
| C17 | D17S1303 | 12 | 0.455 | 0.483 | 0.425 |
| C17 | D17S1303 | 16 | 0.154 | 0.200 | 0.231 |
| C17 | D17S1303 | 20 | 0.014 | 0.000 | 0.000 |
| C17 | D17S1303 | 24 | 0.003 | 0.000 | 0.000 |
| C17 | D17S1303 | −4 | 0.000 | 0.000 | 0.019 |
| C17 | D17S1303 | 4 | 0.065 | 0.067 | 0.044 |
| C17 | D17S1303 | 8 | 0.117 | 0.100 | 0.131 |
| C17 | D17S1799 | 0 | 0.506 | 0.586 | 0.415 |
| C17 | D17S1799 | −2 | 0.000 | 0.000 | 0.011 |
| C17 | D17S1799 | 2 | 0.102 | 0.086 | 0.415 |
| C17 | D17S1799 | 4 | 0.375 | 0.329 | 0.131 |
| C17 | D17S1799 | 6 | 0.009 | 0.000 | 0.028 |
| C17 | D17S1799 | 8 | 0.009 | 0.000 | 0.000 |
| C17 | D17S784 | 0 | 0.324 | 0.339 | 0.309 |
| C17 | D17S784 | 10 | 0.003 | 0.000 | 0.020 |
| C17 | D17S784 | −14 | 0.000 | 0.000 | 0.013 |
| C17 | D17S784 | −2 | 0.134 | 0.081 | 0.112 |
| C17 | D17S784 | 2 | 0.055 | 0.129 | 0.151 |
| C17 | D17S784 | −4 | 0.308 | 0.339 | 0.105 |
| C17 | D17S784 | 4 | 0.015 | 0.016 | 0.112 |
| C17 | D17S784 | −6 | 0.095 | 0.032 | 0.079 |
| C17 | D17S784 | 6 | 0.000 | 0.016 | 0.059 |
| C17 | D17S784 | −8 | 0.067 | 0.048 | 0.026 |
| C17 | D17S784 | 8 | 0.000 | 0.000 | 0.013 |
| C18 | D18S843 | 0 | 0.167 | 0.214 | 0.115 |
| C18 | D18S843 | 12 | 0.004 | 0.000 | 0.000 |
| C18 | D18S843 | −3 | 0.045 | 0.043 | 0.052 |
| C18 | D18S843 | 3 | 0.348 | 0.329 | 0.333 |
| C18 | D18S843 | −6 | 0.000 | 0.000 | 0.006 |
| C18 | D18S843 | 6 | 0.327 | 0.300 | 0.299 |
| C18 | D18S843 | 9 | 0.110 | 0.114 | 0.195 |
| C18 | D18S464 | 0 | 0.706 | 0.677 | 0.224 |
| C18 | D18S464 | −2 | 0.083 | 0.118 | 0.374 |
| C18 | D18S464 | 2 | 0.111 | 0.118 | 0.058 |
| C18 | D18S464 | −4 | 0.035 | 0.029 | 0.259 |
| C18 | D18S464 | 4 | 0.008 | 0.029 | 0.006 |
| C18 | D18S464 | −6 | 0.058 | 0.029 | 0.069 |
| C18 | D18S464 | 6 | 0.000 | 0.000 | 0.006 |
| C18 | D18S464 | −8 | 0.000 | 0.000 | 0.006 |
| C18 | D18S466 | 0 | 0.513 | 0.529 | 0.460 |
| C18 | D18S466 | −2 | 0.411 | 0.414 | 0.494 |
| C18 | D18S466 | 2 | 0.074 | 0.057 | 0.046 |
| C18 | D18S466 | 4 | 0.001 | 0.000 | 0.000 |
| C19 | D19S534 | 0 | 0.742 | 0.800 | 0.309 |
| C19 | D19S534 | 10 | 0.000 | 0.000 | 0.012 |
| C19 | D19S534 | 12 | 0.000 | 0.000 | 0.049 |
| C19 | D19S534 | −2 | 0.040 | 0.071 | 0.019 |
| C19 | D19S534 | 2 | 0.090 | 0.057 | 0.346 |
| C19 | D19S534 | −4 | 0.000 | 0.000 | 0.006 |
| C19 | D19S534 | 4 | 0.123 | 0.071 | 0.216 |
| C19 | D19S534 | 6 | 0.004 | 0.000 | 0.031 |
| C19 | D19S534 | 8 | 0.000 | 0.000 | 0.012 |
| C19 | D19S113 | 0 | 0.108 | 0.114 | 0.035 |
| C19 | D19S113 | 10 | 0.000 | 0.000 | 0.047 |
| C19 | D19S113 | 12 | 0.000 | 0.000 | 0.012 |
| C19 | D19S113 | 2 | 0.254 | 0.200 | 0.118 |
| C19 | D19S113 | 4 | 0.391 | 0.457 | 0.159 |
| C19 | D19S113 | 6 | 0.225 | 0.200 | 0.165 |
| C19 | D19S113 | 8 | 0.022 | 0.029 | 0.465 |
| C19 | D19S254 | 0 | 0.307 | 0.353 | 0.087 |
| C19 | D19S254 | 12 | 0.013 | 0.029 | 0.012 |
| C19 | D19S254 | 16 | 0.101 | 0.088 | 0.355 |
| C19 | D19S254 | 20 | 0.347 | 0.368 | 0.279 |
| C19 | D19S254 | 24 | 0.082 | 0.059 | 0.099 |
| C19 | D19S254 | 28 | 0.071 | 0.029 | 0.058 |
| C19 | D19S254 | 33 | 0.005 | 0.029 | 0.017 |
| C19 | D19S254 | 37 | 0.006 | 0.000 | 0.000 |
| C19 | D19S254 | 4 | 0.006 | 0.000 | 0.017 |
| C19 | D19S254 | −8 | 0.021 | 0.000 | 0.006 |
| C19 | D19S254 | 8 | 0.042 | 0.044 | 0.070 |
| C20 | D20S103 | 0 | 0.366 | 0.286 | 0.199 |
| C20 | D20S103 | −10 | 0.000 | 0.000 | 0.006 |
| C20 | D20S103 | −2 | 0.338 | 0.400 | 0.421 |
| C20 | D20S103 | 2 | 0.017 | 0.014 | 0.063 |
| C20 | D20S103 | −4 | 0.192 | 0.229 | 0.131 |
| C20 | D20S103 | 4 | 0.000 | 0.000 | 0.006 |
| C20 | D20S103 | −6 | 0.003 | 0.014 | 0.068 |
| C20 | D20S103 | 6 | 0.006 | 0.000 | 0.011 |
| C20 | D20S103 | −8 | 0.079 | 0.057 | 0.097 |
| C20 | D20S878 | 0 | 0.596 | 0.636 | 0.187 |
| C20 | D20S878 | −2 | 0.044 | 0.015 | 0.121 |
| C20 | D20S878 | 2 | 0.094 | 0.061 | 0.078 |
| C20 | D20S878 | −4 | 0.176 | 0.152 | 0.211 |
| C20 | D20S878 | 4 | 0.009 | 0.015 | 0.145 |
| C20 | D20S878 | −6 | 0.000 | 0.030 | 0.199 |
| C20 | D20S878 | 6 | 0.059 | 0.076 | 0.012 |
| C20 | D20S878 | −8 | 0.023 | 0.000 | 0.048 |
| C20 | D20S878 | 8 | 0.000 | 0.015 | 0.000 |
| C21 | D21S1884 | 0 | 0.532 | 0.514 | 0.398 |
| C21 | D21S1884 | 10 | 0.000 | 0.000 | 0.091 |
| C21 | D21S1884 | 2 | 0.012 | 0.000 | 0.222 |
| C21 | D21S1884 | −4 | 0.020 | 0.014 | 0.034 |
| C21 | D21S1884 | 4 | 0.042 | 0.043 | 0.034 |
| C21 | D21S1884 | 6 | 0.390 | 0.400 | 0.136 |
| C21 | D21S1884 | 8 | 0.004 | 0.029 | 0.085 |
| C22 | D22S420 | 0 | 0.215 | 0.186 | 0.256 |
| C22 | D22S420 | −14 | 0.000 | 0.000 | 0.023 |
| C22 | D22S420 | −16 | 0.000 | 0.000 | 0.006 |
| C22 | D22S420 | −2 | 0.380 | 0.343 | 0.233 |
| C22 | D22S420 | 2 | 0.241 | 0.329 | 0.122 |
| C22 | D22S420 | −4 | 0.041 | 0.057 | 0.122 |
| C22 | D22S420 | 4 | 0.078 | 0.057 | 0.047 |
| C22 | D22S420 | −6 | 0.009 | 0.014 | 0.081 |
| C22 | D22S420 | 6 | 0.022 | 0.014 | 0.023 |
| C22 | D22S420 | −8 | 0.013 | 0.000 | 0.087 |
| C22 | D22S420 | 8 | 0.002 | 0.000 | 0.000 |
| C22 | D22S689 | 0 | 0.349 | 0.279 | 0.256 |
| C22 | D22S689 | −12 | 0.023 | 0.000 | 0.006 |
| C22 | D22S689 | 12 | 0.054 | 0.059 | 0.070 |
| C22 | D22S689 | −16 | 0.005 | 0.000 | 0.000 |
| C22 | D22S689 | 16 | 0.009 | 0.000 | 0.006 |
| C22 | D22S689 | −20 | 0.000 | 0.000 | 0.035 |
| C22 | D22S689 | −4 | 0.087 | 0.088 | 0.076 |
| C22 | D22S689 | 4 | 0.319 | 0.368 | 0.297 |
| C22 | D22S689 | 6 | 0.000 | 0.000 | 0.012 |
| C22 | D22S689 | −8 | 0.020 | 0.074 | 0.116 |
| C22 | D22S689 | 8 | 0.136 | 0.132 | 0.128 |

The Structure software (Falush et al., Genetics 164, 1567-87, 2003; Pritchard et al., Genetics 155, 945-59, 2000; both incorporated by reference herein in their entirety) was then applied to these data to estimate the distribution of European ancestry of individuals according to disease status and self-reported ethnicity (Table 55). Structure infers the allele frequencies of K ancestral populations on the basis of multilocus genotypes from a set of individuals and a user-specified value of K, and assigns a proportion of ancestry from each of the inferred K populations to each individual. The analysis of the data set was run using the admixture model, where the ancestry prior α was allowed to vary among populations. This is an important option when genetic material from the K inferred ancestral populations (in this case the African and European ancestral populations) are not equally represented in the dataset. This is clearly the case in the present data, which contains 3366 self-reported European Americans, 584 self-reported African Americans, 364 Icelanders and 87 Nigerians. The Structure program was run multiple times for each K in the range 2 to 5. The Icelanders and European Americans data was used to identify the European ancestry component in the African Americans and the Nigerians to identify the African ancestry component. Based on these runs, there is evidence to indicate that K=3 provides the best estimates of European ancestry in African Americans. First, these estimates correspond closely to independent group estimates based on Long's weighted least-squares admixture estimator ((Long et al. *Genetics* 127, 417-28, 1991). Second, K=3 results indicated the existence of clearly defined African and European ancestral gene pools and a third gene pool, that contributeed a small amount (1-2%) to European and African Americans, but nothing to Nigerians and Icelanders. An independent Structure analysis that also included Native American and East Asian reference samples indicated that this third component represents Asian ancestry. When K>3 the European component becomes divided equally among the additional ancestral gene pools, whereas the African and Asian components remained stable in single components. Thus, K>3 did not provide any additional resolution to the data. The estimates of European ancestry for African American individuals were strongly correlated between different runs of Structure, regardless of the value of K. Thus, the average Spearman's rank correlation between runs was 0.987, with a minimum of 0.964. The statistical significance of the difference in mean European ancestry between African American patients and controls was evaluated by reference to a null distribution derived from 10000 randomized datasets.

The data includes group estimates of European ancestry obtained by applying a weighted least-squares (WLS) estimator (Long et al. *Genetics* 127, 417-28, 1991) to a subset of the microsatellite alleles that exhibited the greatest differences in frequency between European and African populations (in accordance with the teachings in Parra et al. *Am J Hum Genet* 63, 1839-51, 1998). Overall, there is a close correspondence between self-reported ethnicity and the estimated ancestry derived from the genetic markers and also between the estimated individual ancestry (Structure) and group ancestry (WLS). In particular, the almost perfect assignment of African ancestry to the Nigerian Yorubans and European ancestry to the Icelanders indicates that the admixture estimates of the American cases and controls are reliable.

Long's weighted least-squares measure of admixture was calculated using alleles from the set of 75 microsatellite markers. Frequencies from Icelanders and Nigerians were used as representative of the ancestral allele frequencies of the European and African gene pools, respectively. In line with Parra et al., only 16 loci with alleles exhibiting large differences in frequency ($\delta$=0.5) between the two parental populations were used. In the case of the African American cohorts, the WLS admixture statistic was calculated using the European American controls from the same city as representatives of the ancestral European gene pool. In each case, the estimate of European ancestry was higher by about 0.01. This is likely to be the result of the small fraction of African alleles present in the European Americans and indicates that Icelanders serve effectively as representatives of the European component of the European American gene pool. The WLS admixture statistic was also calculated using alleles of all the 75 microsatellite markers, yielding estimates of European ancestry in African Americans that tended to be a little higher than those reported above (by 0.01-0.02).

Estimates of genetic ancestry were obtained from the Structure software, using the parameters and data described above. We note that the output from Structure does not label the ancestral admixture proportions as either "European" or "African", but rather as "inferred clusters" 1 and 2. However, the distribution of ancestry from these inferred clusters in Icelanders, Nigerians and the American cohorts suggest a relatively straightforward correspondence with the labels "African" and "European" ancestry

TABLE 55

Distribution of genetically determined European ancestry in MI case-controlled cohorts

| Cohort | Self-Reported Ethnicity | Disease status | WLS group estimate of European ancestry (Std. Err.)[a] | Distribution of estimated individual European ancestry[b] | | | |
|---|---|---|---|---|---|---|---|
| | | | | Mean | Std. Deviation | Median | 25-75 percentile range |
| Yoruban Nigerians | African | N/A | N/A | 0.036 | 0.024 | 0.03 | 0.019-0.043 |
| Iceland | European | N/A | N/A | 0.991 | 0.015 | 0.994 | 0.990-0.996 |
| All American | Eur. Am. | Patients | 0.98 (0.0083) | 0.965 | 0.083 | 0.991 | 0.977-0.995 |
| All American | Eur. Am. | Controls | 0.979 (0.0079) | 0.969 | 0.07 | 0.992 | 0.979-0.995 |
| Philadelphia | Eur. Am. | Patients | 0.974 (0.0101) | 0.955 | 0.101 | 0.99 | 0.971-0.995 |
| Philadelphia | Eur. Am. | Controls | 0.969 (0.009) | 0.959 | 0.09 | 0.991 | 0.969-0.995 |
| Cleveland | Eur. Am. | Patients | 0.982 (0.0079) | 0.971 | 0.068 | 0.991 | 0.980-0.995 |
| Cleveland | Eur. Am. | Controls | 0.981 (0.0081) | 0.972 | 0.06 | 0.991 | 0.979-0.995 |
| Atlanta | Eur. Am. | Patients | 0.995 (0.0075) | 0.981 | 0.038 | 0.991 | 0.984-0.994 |
| Atlanta | Eur. Am. | Controls | 0.982 (0.0092) | 0.973 | 0.066 | 0.993 | 0.983-0.995 |
| All American | Afr. Am. | Patients | 0.243 (0.0138) | 0.223 | 0.184 | 0.178 | 0.108-0.282 |
| All American | Afr. Am. | Controls | 0.213 (0.016) | 0.199 | 0.145 | 0.174 | 0.094-0.267 |
| Philadelphia | Afr. Am. | Patients | 0.252 (0.0178) | 0.235 | 0.195 | 0.188 | 0.121-0.288 |
| Philadelphia | Afr. Am. | Controls | 0.213 (0.0217) | 0.186 | 0.137 | 0.157 | 0.082-0.257 |
| Cleveland | Afr. Am. | Patients | 0.232 (0.0222) | 0.21 | 0.174 | 0.16 | 0.096-0.282 |

TABLE 55-continued

Distribution of genetically determined European ancestry in MI case-controlled cohorts

| Cohort | Self-Reported Ethnicity | Disease status | WLS group estimate of European ancestry (Std. Err.)[a] | Distribution of estimated individual European ancestry[b] | | | |
|---|---|---|---|---|---|---|---|
| | | | | Mean | Std. Deviation | Median | 25-75 percentile range |
| Cleveland | Afr. Am. | Controls | 0.239 (0.0219) | 0.223 | 0.136 | 0.191 | 0.127-0.281 |
| Atlanta | Afr. Am. | Patients | 0.226 (0.0246) | 0.206 | 0.166 | 0.167 | 0.098-0.283 |
| Atlanta | Afr. Am. | Controls | 0.198 (0.0128) | 0.193 | 0.155 | 0.161 | 0.086-0.252 |

African American MI patients have, on average, a slightly greater European ancestry than the African American controls in the Philadelphia and Atlanta cohorts (Table 55). When all three cohorts are combined, the African American patients and controls have on average 22.3% and 19.9% European ancestry, respectively (one-sided P=0.046). This difference can largely be accounted for by a handful of individuals who are reported as African Americans, but have a relatively high European ancestry. Potentially misclassified individuals were corrected for by excluding from the study self-reported African Americans with <20% African genetic ancestry according to the Structure results (seven patients and four controls). The result was a notable reduction in the difference between patients (20%) and controls (19.2%). Tables 52 and 53 show that controlling for ancestry, whether by excluding potentially misclassified individuals or by using individual European ancestry estimates as covariate (Pritchard et al. *Am J Hum Genet* 67, 170-81, 2000), referred to as admixture adjustment, has a negligible effect on the RR and statistical significance of HapK's association to MI in African Americans. Thus, the higher RR of HapK in African Americans is not simply a consequence of differences in European ancestry between patients and controls.

The African American carriers of HapK have, on average, more European ancestry than those who do not carry HapK, 28.9% against 19.8% (two-sided P=0.00008). This is consistent with the observation that HapK is not found in the Nigerian HapMap sample while it is relatively common in Iceland and the CEPH CEU samples used in the HapMap project (See Table 51). Although HapK is also common in the Asian HapMap samples, the Structure-based estimate of Asian ancestry in African Americans is small (~1%), supporting the hypothesis that HapK observed in African Americans are mostly of European origin. Furthermore, we could detect no difference in Asian ancestry between African American patients and controls or between HapK carriers and non-carriers.

The LTA4H gene resides within a single linkage disequilibrium (LD) block in both European and African populations and is the only known gene within that block. To identify a single causal variant captured by HapK, a 75 kb region encompassing the LD block containing LTA4H in a number of pooled DNA samples of Icelandic patients and controls (some of which contained only HapK carriers) was sequenced. In addition, the correlation of HapK with other SNPs in the HapMap database (Phase I, version 16c.1) was examined. The best single SNP surrogate of HapK identified through both of these approaches was rs2660899 or SG12S551 ($R^2$=0.7 in the CEU samples). This SNP was genotyped in the Philadelphia cohort, where HapK exhibited the strongest effect. While its T allele conferred a RR of 1.31 (P=0.008) in European Americans, it did not capture the RR conferred by HapK in this African American cohort. Thus, rs2660899 can be ruled out as a sole causal variant captured by HapK. However, this SNP may be used as a surrogate for HapK in defining carrier status and MI risk due to HapK.

In theory, the observed association of MI to HapK could be the result of association to a causal variant in the neighbourhood of LTA4H but outside the LD block. This scenario might explain the high RR observed in the recently admixed African Americans, potentially boosted by strong admixture-derived LD, and the modest RR in the non-admixed groups of European Americans and Icelanders. However, given the existing patterns of LD in European and African populations, the kind of admixture found in African Americans, which was examined by creating a 4:1 mixture of haplotypes from the Yoruban and CEPH HapMap samples, is not expected to produce a correlation between HapK and any known SNP outside of the LTA4H LD block with $R^2$>0.25. Given that the observed effect of HapK on MI is very strong in African Americans, it is implausible that the association is the consequence of a variant only loosely correlated with HapK. Moreover, an analysis of five markers with significant allele frequency differences between African and European Americans controls that were located just outside the LTA4H LD block, revealed none that were associated with HapK or uncovered differences between African American patients and controls (Table 56). Thus, the difference in local ancestry between African American patients and controls appears to be limited to HapK.

TABLE 56

Markers used to evaluate the local ancestry arount LTA4H

| Marker (allele) | Location | Eur. Am. controls (n) | Afr. Am. controls (n) | Afr. Am. patients (n) | P-val 1 | P-val 2 | Icelandic controls | HapMap CEU (n) | HapMap YRI (n) |
|---|---|---|---|---|---|---|---|---|---|
| *DG12S1668 (10) | 94966113 | 0.238 (1105) | 0.072 (215) | 0.072 (145) | 1.60E-17 | 0.85 | 0.218 (808) | 0.25 (56) | 0 (54) |
| rs2660885 (C) | 94958339 | 0.805 (1720) | 0.644 (374) | 0.629 (190) | 6.40E-20 | 0.65 | 0.854 (833) | 0.85 (60) | 0.442 (60) |
| rs2660875 (T) | 94949965 | 0.535 (1725) | 0.4 (380) | 0.38 (183) | 1.50E-11 | 0.41 | 0.496 (795) | NA | NA |
| rs2660850 (T) | 94946089 | 0.827 (1742) | 0.68 (381) | 0.696 (189) | 1.40E-18 | 0.58 | 0.866 (830) | NA | NA |
| **DG12S1664 (0) | 94887493 | 0.873 (926) | 0.721 (201) | 0.758 (126) | 7.60E-13 | 0.28 | 0.856 (825) | 0.873 (55) | 0.509 (55) |

Table 56 displays the allelic frequencies of markers flanking the LTA4H gene with very significant differences between European American and African American population controls, characterized by the "P-values 1." The "P-vaules 2" measure the differences between African American patients and African American controls adjusted for cohort and ancestry, all non-significant. The markers used in this analysis of DG 12S1668 are "forward primer"—GCAGTTTAAGCTGTATGTAT ATGAGG (SEQ ID NO: 727), and "reverse primer"—TGAAAGCCATCACTG-TAAGGA (SEQ ID NO: 728). The markers used in the analysis of DG12S1664 are: "forward primer"—GGAAGGAG-GACACTTCTGGA (SEQ ID NO: 729) and "reverse primer"—GCTGTGAATGGCTAAACTTGG (SEQ ID NO: 730). As shown in Table 57, the location of the primers are the basepair position on chromosome 12 in the human genome assembly build 34 (National Center for Biotechnology Information (NCBI)).

It is striking to discover a genetic variant that confers such different risks of MI in African Americans and populations of European descent. This suggests a strong interaction between HapK and other genetic variants, and/or non-genetic risk factors, such as lifestyle, that are more common in African Americans than in European Americans and Icelanders. These results emphasize that although genetic differences between human continental groups are small (Bamshad et al., *Nat Rev Genet* 5, 598-609, 2004; Jorde et al., *Nat Genet* 36, S28-33, 2004), some of these differences may nonetheless contribute to ethnicity-based health disparities (Royal, et al., *Nat Genet* 36, S5-7, 2004), whether through frequencies of risk alleles and/or risk conferred by such alleles. A strong correspondence between self-reported ethnicity and genetically estimated ancestry had been found. However, ancestry is a quantifiable trait, particularly in heterogeneous or recently admixed populations such as African Americans, which needs to be assessed in order to reliably interpret interactions between ancestry, genes, and environment in the pathogenesis of disease (Reiner et al. *Am J Hum Genet* 76, 463-77, 2005; Barnholtz-Sloan et al., *Cancer Epidemiol Biomarkers Prev* 14, 1545-51, 2005; Hoggart et al. *Am J Hum Genet* 72, 1492-1504, 2003).

The results from this analysis indicate that African Americans are an especially promising target population for the anti-leukotriene therapies described herein. At risk individuals of black African origin that exhibits HapK or other risk factors described herein are specifically contemplated for prophylaxis therapy according to the invention described herein. In addition, HapK or its surrogates may be an especially promising diagnostic marker for defining risk for cardiovascular diseases such as MI and stroke, especially in African-Americans, that may lead to more aggressive treatment of this and other cardiovascular risk factors and modification of lifestyle.

SEQUENCE LISTING (730 sequences)

SEQ ID NO: 1 - DNA, 214000 bp, Homo sapiens
gactaagatgaatatgcattcattcaccaaaatctcatattcccaaaaagcaggaaaggtagtacagtgagatggatgatgccttcacatgactcagatgtcacgtgtttctcaccattgagacccccaaggcaccccctcccagcatttaccagaatgtgtgtgtaactatttacagtgatttgtgtaattatttgattgtttctcttgtatcctgtagcaatgagggtagagattatatcccacctaccactgcagctccaggatccagcttcacaaacatttgttgaatgaatgaataagaaaagaggacacccccaaagaggctgcaagggaaaaagctacaaagacagaagcaccaggaaaaagtagggtcatgtaagtcaaagcaggaaaaaagttccatggtggggtggtcagcagtgtctaatgccacgaaggcacaaagtaggataaaggttaaaaatcagcctttggttttggcaaatatgaagcttatcggtagccttagcgagaacaattccatcagggagcagaagctaactgcagtgggttgagtcatcaagcaggcataaggaagtagggataccccattataagctactctttcaagaagctcaaatctgaaggttaggagaattaggtcagtagctagaaggaaatgtggagtcgaggggctgtttttcctcccaaggagtataaaggtgtaacgttgcatgaaaccacttcagacaaaggccgatatcaatagagaagttaaaacgcacgcctcaagatttgggaaggcttggggttgggcttaaagaggtaggagcatatttcctatcctaggacagagaataaagaagaaaggataggttcccatggagataaatttctaagtgttaaagaagaggctcagaaaattctagcatgataggctcacttttttctttttccatgaaggagatggcaaagtcaactgacatgagaaaggtgacaatactgatgggttgaagagcgatggacatttgaaataacttcttagaccagtagaggctggagttcataaatcagaactggctacaggttatatatgtttttttttttttctccaacagcataagataacagagcgaagtctgtagaaatgaaagaagagtcagatgaggatagctggagctagtgcaaggagggaagcaccacggtgggagccaggtaccccctggatttataattcatactgaattccaacaacagaagggctctaagcaggagagtgacagatttcagaagactgagacacatttggtaaaaaaaagtaggaggaaaacctgattctggaattagggcagccaatagacggcagtattttcagaaaggagggaatggtcaacagtgactttctagtctggagctcaggaggaagaggcaactctacctgatggtattaagatcatggaggtagctgagatcacctagcttgtgtgtgtcaaatgagaaaagaagaaagaataggagaagttccccaggaacacagacattaagtggggctgtggtgacaacacaagaagagaggcttgcaaaggagcctgagcagctgtcatgagagaggtaggatggtggactcggagaagaggcagaagatgttcttaaaggaaggacactgctgccaagtagtcagccaattggtgacaaagaaagaccctgttgcgagaaaaaaagtcagtgaagtagtaggaacgatgacagatgacactgggttgaagactgaggagagagaagtgtaagagtggaagcagagggcagaccactcttctgagacactgaagaggcatagttagaaataaaggggagtcgccagaaaggaatttgtggctaagcaagaggttttctttaagactgaaatacataagcatgatttaaatgctgctgggatggagttcacagacctggaagacagaagacaaagcggatcatcaagatagtggaatttactgaaatgagagaggaaaatcccatccacaggaaatgcagacatgagggaggggccagaaggacagtgaaaacatcagcaactggtcccccaacttctgagtgaatgtggagatataatcaggtaaaggactgcatcatctccctggttaatgatggagtcagagaaaagagtgtcttatacagaagttgtgatatacttggccgggcgcagtggctcacgcctgtaatctaagcactttgggaggccaaggcaggcggatcacctgaggtcaggagttcatgactggcctggtcaacatggcaaaatcccacctctactaaaaacaaaagcctgtaatcccagctactagggaggctgaggcaggagaatcgcttgaacccaggaggcagaggttgcagtgagccaaggtcgcaccactgtactccagcctgggcaacagagctagactcagtctcaaaaaaaaaaaaaaaagatgtatttattctcactgtataaatttctgtgtaagaaatactctctcatatagaagtaaatttatatataaaattatatagaaccactataaaatactcaggtttataaaatttatatataaacttgttgacatataaaattccatgtaaatgactataaagtactcttatatgaaaagtatatgaattaaattatatatcaacttacttttatattacagtatttttgttatacagaagtttatatagtgacaataaatatttctcaagaacgatttcacataatagaagtataaattatccatttccaatagtgaaaaagaaaagcagttccacaccagtgacagggctacgaatctaagaggtacaaagacttcattcttagagacactgaggtcagggcatggccaacacatctgaagctgatagaattggcgctgggttggttggagacggtacggtattactattacaatggcagacgcttggccttgataactagccaatcagggggaaagattctggtttcctctgttattatctgaactagtgtgttcccaaagggttaagatggtttatggaaggcacaagatcagcaaaccataaaggattagcactaagaaggaaggaagtagaccaagtgttaatggcgatgccatgtaagagccaggtctgcgatgtatgttctacatggtttggggggtaaaaaaaatgtcagcctccagagcacagggctttaagcctcaagtactgttaacagtagagtttactagtctacagcaggaattacaaccagtaattctaaggccaattactcaggcaagttttactagaacaaggaagctctgcttcgaggtcaaatcgatttctgcatttatagaagcatctagatgttctctgttcaaacaatggggtaaaatccccacacattttatttctgacagagtgttccctatattgcctggccaggagtgataacattgcttggctattattaataaaacattgctgtggctgggcgcagtggctcacacctgtaatcctggcactttgggaggctgaggcaggaggatcacttaactccaggagtttgacagcagcctgggcaacatagcaagatcccatctctctaaaaaattttaaaattagctgggtgtggtggcagacacctgtagtcccagctcctcaggaagctgaggtgggaggatcacttgagcccaagcaggttgaggctgcagcgtgctgtgactgtgccactgcactccagcctgcgcaacacactgagagagactctgtctcaaaaaaatacatcaaataaaaattaaaagcccatttctttcttttggtacattacagccatgcacttcaaaggctagcacaattatttttctgcagttctatatttagattctagttagaagtaacctaggaccttcatgttagaggtgtctttggcaaaactgttatgtgagtgaaacgtttaatcaattgaggataaagatgcctcattgctaatgaagatgtggtttaaggattttatgcacccagttcatttattaacaacttgtttaagctttattagctgggtctctactttataactgtgttctttaatttacaagacaataaaaattaaaatggtaaatgggaaacctatcttgcttttcaataaataatttattttaataacttcgtgggcatggtggccaaaacattttagctgtgaaaataatttcaattcatatttttttggaatcaatattaaaaggtgatatattctcaaatgaaaagtggacaaatgatcagttataggacatgattaagaaactaaccatgagccacgtgcagtggctcatgcctgtaatcccagcactctgggaggccgcggtgagcggattgcttgagcccaggagttcaagaccaggctgggcaacatggcaaaaacccggctctactaaaaatgcaaaaaaaaaaaaaaaaaaaaaaatttagctgggttttggtggcttatgcctgcagtcccagctactcgggaggctgactcgggaggctgaggcacaagaatcatttgaacccaggaggcagaggttgcaatgagctgagaatacaccactgcactccagcctgggcaacagagagagagagactcagtctcaaaaaacaaacaaacaaacaaacaaaccgctgccctgtgcttggagagatctgtttacctttaccactaaagactgttggaagtaaattttagaaggtttataatacctaaaagtaatcacttctgtcttatgaaaggttctgctgagatttttctattgtggccactagtggcaatattccagaagtcatatttaaagaatatctttagtggattcagcagtttttcaaatatgtacttttatctctccaacattcatgattgcaatttttcaaattaacctcatgatataaacaactgtactctatgatgcctcatagtacagaaactggaggcagaaagagaagttgaatgtctaagaatcggtaattctaaaactcaacatagaccattcagcattagtggttctaacaatcccactgcaaaatgagttgataatgtgtaacactttagtgaactaaagcataaagaaccatggtctcctaatgcagcaaattaaaacacatgatagctacaattaatgaagtacatagtcctggctgggcactatggtacgtcctttacatagattatctcttaaattattaaccccgttttagagatgagaacattcgggctcaggaaggttatgtaagttatataaaaatcacaaaataagagacagagctaagatttgaatccaagtgtgaccaggttcatatcaagcttccatttttgaatttatattagaggtcaataactcacctttgtccttttaaaataatttttggctctgtgacctacacaggcaagctgttatttacaaacaacccacacatctagatggtcactgtctcaccgcccacttttaccatcaggactcctagtgagctgtcaaggggaatgctataattttggaggttctaaatctgagggcttaagaaagaaagaaattgtaaaaagcaggcattactcaggggcatagattgtcaggcagatctgtcatgcttataggtaacctcccagggccaaaaatatatgtgcccaaactgcctaaatatttcctgtcacttcataatactgcctgaaatcctgccaaattagaacttcatttgtgttgcttgtcaatttttaacgcataagcaaatcacctggagatcttgttaaaatgcaaattctgattaggttaggtctgggtctgcatgtctgatatgcttccagagggcactgatgctgctggtccatggaccacacttaaagaagcaaaaaagatgtctgatatttactctctggctgcctaggagtgcttctcatttaagtgagatctctttgtgcatcataatgggagggatgagctgaaaagcagcaaattaagagtgagttaagtgtctacctcacttccctactatctgtaacaagcaggtttgggcactgtggtcaaccagaaaattctttccaggaccacaacccttgagattatgttgcaaagatgcaaggacaacttagaaataatttccagcactggtggcactggatgtctgtcagtggtgctggtggcagggtcctattcagactgtggtttacctgcctggcccgtttggttatgggccattttctgagtaccatggagcatcgcccagctgacaagggcttgtactccacccttggtgcgcagaagggaagcttggctgctactaagtttggtgcaaagtaattgtggttttgccattaatatttgatacagtgagtccctactttcctcaggtgaaactagaacttaaggggacacgctcaagttctcattatacagtactaagtttcaaaaatcagcaattttatcaaacacatgctctacagcagtggtcggcaaactttttctgtaaggggccagagagtaaatgttttagagtttctgggccacatatggtttctgttccagctataaactctgccactgtagggcaaaagcaaccctccacaatacatacatgaataggtgtgttccaaaaaaactttatttgtggaccctgaaatttgaatttcataaacttttcatgtgtcatgaaatattcttttgattttttcccaaccttttaaagatgtaacaaccatttttagcctgtaggccatatagaaacaggcagtgggctgggtttgctgacccttgctctgaagcaatgatatctcgatccaatttatacccacaaatttttctccttgaaaccatgcatttaattctcatctcttcttaccatgacaataagaagttattctatataacaaagagattgtacccacccaagccagcatttagatcatgtcatttgcttcctcaaaattttggtctttataaaaatcaattaaagcaccttaaaaggtaagcagtgatgaaatatttgaaataattggctaattaaacatcacctaaatagaaactgtgataagaaccacaaatgcgaaaaggaatcatgtagtaactaatgtggaggatatcttggtttagagatttgatgaacacgagttttgatttaaaaaaatttgtgcaatactcactgctttggtggggagcttgctatgcaagttggtagaaaaatttatcctaaagtcacagttctctaccactctggattttctcgagctaactaccattccaaactattttaggcacagttactagtttcaagaatcaggcaaattgccctggtattagcactgttctttctgtggtcacaagtcaaactactgtggtgaataaaattagatgatttctttagtctttcctttttcagcccctgtagtcaatttccagtgctccattcaaagaaaaaccaaaaatgtccagaatataaccttattttaaaacttgttaaccactgatttcacttgttaaccaaatttttttttttttttttttgagaatgaatctcactctgtcaccaggctggagtgcagtggcatgatcttggttcactgcaacctccgcctcctgggtactggttcaagcaattctcctgcctcagtctcccgagtagctgggattacaggtgtgcacccccacacccagctaatttttttgtacttttagtagagatggggtttcaccatgttggccgggctagtcttaaactcctgacctcgtgatccgcccgcctcggcctcccaaagtgctgggattgcaggcatgaaccactgcgcccagcctgttaaccaaatttctaatcacacacacttgaggcccagtaaatgcctgctgaaaagagggtgctggtggtgaggcaactgaggggctaacatactgatagctgctgaaatcttctacagctctttcttgttagaacactccatcacggctcccaggcccacaccacatgaaggaacttctagctctcttgcttgctctttacccaaatgtagttagcaagtcctgggaactaaacagcattgacacacttgaagaagacaattaggcaaatcccaactgctgtgctcctgcagctaaagatgaagactcgtccattgggcagttgattaattgtacctagaaaattaatttcaatggtcccatgacaacatacgggcagtgaagctctagtgttccccctgggtggaatcttccaggatgtatagtctcccataccagctcatcctcccatttttccagattctggttcttctctcttacctagtgtgtagtgggccaaatggtggtcccccaaaaagatatgtccatgtgttaaccctggaaactgtggatgtaaccttatttggaaaaatggggccaggtgcagtggtgtgcatgtgtagtcccagaactttgagaagccaaggtgggagaatcgttggagcccaggagttcaagaacagcccaggcaacatattgagacccccgtctctataagcaataaaaaattagctaggtgtggtggcatgcacctgaagttccagctacttgagaggctgaggcagaaggactgctcaagcccaaggagttcaaggctgcagtgagctatgatcatgtcaccccactccagcctgggtgacagagtcagactccctgtctcaggagaaaagaaaaaaaggtctttgtaaatgtaataaagaatcttgagataagatcatcctgatttaggatggaccctaaatccaatgacatttgtccttacaaaagaaaggtagagggaactgtgagacagacacagaggggagggccttgtgaagcaggaagcatagatgcagttacaagtcaaggaatgccaaggactgtctacaaccagaagccaggagagatgcatgggatgatttctccctcacagcctccagaacttctggcctccaggactgtgaagaatcaatttctgttgttttaagccaccaagtttgtgtgtcatttgttatggcaatggcagtattaggactctaatacacagtataaaaaaataaaaatagggccaggcgtggtggctcagacctataaccccagcactttgggaggctaaggcggggagatcacttgaggtcaggagtttgagaccaaccaggccaacatggtgaaaccccatctctattaaaaataaaaattagttgggcatggtggtgtgcatctgtaatcccagttactcaggaggctgaggcagaagaatcgcttgaacccaggaagtggaggttgtagtgaatgccactgcactccagcctgggtgacagagctagactccttcatcctaggacacagccaagtcttacgtagcaaaaagaagttgttaaaggtctgtagttctgcattaagcaacacaggcatgtacctatgaattatatgattataaaagtgctcggacaggcccatttcaaacttggcctctttccaccaactgtgtactgtttctcattccataactagagattatgtctttatatcctgtcaaaaaagtgaatttttgtgggctaagacattatccctgtgttaaatgcaccagtcttagtgtaaacaagcctagttcctttttcattttggctgtctagtatgcatttgtatatgctaggcagtgtactaggcaccttaaatacattaccttgtttaacctctacaggattctgggaggtaggcattatccccattttatagatgagaacactgagaagacaatgttcataagtgcgtcacttgtctgagatgacatatttactaagtagcagaaccaggcctcgagctactcagtctgatttccaaagcccctgctcttaatcacatcaacttctttcctatatcacctttcccagagtgcgctctcatggataaagagcagaagtataagttactaggcagcagaaaactgtagaggtgggaagattagataaaaaatgtaaataagaaggctttaagacaccaaaatcaaatgtaaatactttataacctgaatcagtgcttgtgttcatgaggctagaggtcgtgcattttatctctaggtctggtgatgccaatcctgatctacagccagcagcaacagttccctagcctgcctagaagtttgtaaatgcatgggctttggtaggaggaagacgagagaaagcagaacagattattacaaacccagtgcattcccccttgatgggtcaacagcgatttctttgtaagtgaaggacagcacactggttttgatgactcacgagagagtaggagggaaaaagaagtctgaggcattgcctggaagcctcgctctgcttaaacaagtacactaatggctcatgcctgttactcccagcactttggaaggccaagatgggtggatcacttgaggccaggagtttaagcccagcctggtcaacatagcgagaccttttctctattaaaaataaagaagaaagaaagtaataatgattcaagttctcattctctacaaaattcacttatgactttccaaatgctagtgaaaacttttaggtattgcaaaactgccttaatgcataacgggattctcattttacttagtctaagatgactttttcactttgaacttctgcatctttatgatcgcttagctttctgacaagcaatttcagtaagtgtttatcaatttgcatccacacgctgacacataggggtctacttacatatccttcatgtaattgagcttttgtaaatcatctttctacatggtacacttctgattttgtgtgcagctttcttgtttaagcactgtattaaatgctctgcttcctacacccttaggaacaatgagaataaaagcgtaatgttggttacttcttcatatcaaaggaagttcatctcctggttattaaaagctattattaaatggccatctttttgtgcccctgtgttaagcactctaccaagataccattaaatagataagggccacactccatagagatgatggttctatattctgtattttctgggggagttctaatttcatgcaattccttcttcttaaataaaggcaattctctaaatatattacctaatgtgctttcactttcatattcttgtaagatttttcacataaatcaattctcaaaaaatagtatcataggccttttaaaaatagtcatgttcaaaagtcaggctcatgaataaatgtgtgcattcattacatatattttcataaattcaaatttaaaagaataagagtagctagaaggtggaagaaaaatcttattctgattaggaatgcacaatcacaagaaaatttgtgatatatatagtcattttattctgtattgttttattttgattttggtaagacaagaaacaatgtagaaagtttgacaacttaaaaaagtaatatgagtgtgagaaagtcctcttccaggattagcaaaaaaatggttttttttttttttttttccgagatggagtctcgctctctcgcccaggctggagtgcagtggcgcaatcttggctcactgcaacctccgcctcccgggttcaggtgattctcttgcctcagcctcccaagtagctgggactacaggcatgtgccaccatgcccggctaattttttttatttttagtagagacggggtttcaccatgctggccaggctggtcttgaactcctgaccttgtgatctgcccgccttagcctcccaaagtgctgggattacaggcgtgagccaccgtacccagcctaaatggccaagttttattatggacaattaagctgtagaataaaaatctacttttaatagctggcatagtgcctagtggttttgaagccacaagcaggtttacaaaaaacatttaaatccatctgaatctacagaaaactaagattacctaagcagaaaatgaaaatagttcaggattaaggaagattaacaaatgaagagtatatgtattttagaagtattactttatatttttatagtataataataatatttacgttcctacacttataatgagtttcgtatatatattaaaataatttaatggattagtatgtttatatttgcttttagtaaatttggtgtatgataaactcagttgtctacattgtgagactacacctgaggcaatttctgtgttgatatatacctgaatagcagatattacttgggagcaaataaaatagcttcaggcctaattttgcaagttcatgatgggagagtaagcatgacttcaaagaactgactttgagttaaaacttgaagaatgaatgtgacaacagcaagtataaaacaatgccaggcagaggtgggactgttcatgggtatcagggtaagtgtgttgataaatgctcaaagtaggaaatacctttcttcccccacacatgtcagaaaataactgcaatagaatgcaacgacatctcagagataaagtgttcaacttagctctcagagaccgttcagttacattttgtaatgacattggaattgattgcattttgaaggcaattctaaatgcaaagtcttcattttgttgatagaagctgggttatttattatgaaatttcaaaaattaagtaaaatatctaattaggattataccagcaaaggcaaatttagaattcaagacttcatgatccatggtaagattattttaatgcaactctgctaattaactgaaatttcctttaactctcacatctgccttttacttcttaagacatttttctagtatttcaccagagcaagatatcagaagggtaaatctcttaccaatgaactttgctaattcttagtgactccgttgaccctggtgtaaggatcaggaacaaagtgaatgaaatacattttaatacatttctgctttctctaattccaaagaccactctaaagaataagttatttgtgggtattatctgaaacttgggattaaaagagaccgtgattacccttcagggattttggcaaaacttaagccatttcatctgaagagcaaagcaagcctcccacactcttggcttattctcacaattatctagatatctagcaacaaaactcttgagtagtttgttaactacagatgccaagggctgacagtttcactttcagttttcagaatatcttttgtttcagtggtgtaagcacaccatcagaatctctactatttaaaataattaagttataattgtaacttccattagatgtagtacttaaaggaatctagaagacacaactcattaattataggaatttgactgcaaattcttctggggggtctgaattgcaaaggaggcatctttgtaagtcagactcaactcattactctgtgatgcaggctcctccaaatggcagcagaaacgtattactctctagaaacactacagtagtgctacaatttcagggttctgtagagataaggacaaattgacagaaacacattcttagaaggacagtatcatttaaaataaaaatactgtcataattgtacaccaggatagcttctccataataaattctttatgattttctgatttttagaaatcagaattgaactttttaatgtgaaaaaaatgagagaattgtttcaaaataggaccacatttctgtgtataattttaaaagtttaaaaatatttgattagtagactgataaactgaaacatttttgataagcttttcattacatacaaaccatataatttgtaaaaaattggaaattattcaaaacttcacataactaaagtgaccaaataaatactggagaggaaagaaaaggagtcaaatgaatctagcattttctttttttttttttttttggagaaagggtctcactgtgccacccaggtgggagtgcaatggcacgatcatggctcactgcagcctcaactttatgggcttaggtgatcctcccacctcggcctcccaagtagcagggactacaggcatgcgccaacacgtccagctaatttttttggtattttttgcagagacgaggtttcaccaggttgccgtggctgatctggaactcctggtctcaagtgatctacccaactcagcctcccaaagtgctgggattacaggcgtgagccaccgcacccggcctaatctagcattttctaaaaggaaggacccagcagtgaacggcaatatcaataatcatgttcaagactatcagacatgcaagctggggatgaatgggtggaaggggaaaatgatgaataaatgatgaacacaagtatagacccagtggatttgagatgcccaagatgccagtgagatattcaaagtttaactcaaaagccacttcccatatgaaatcctgacaaacactcctacgtccaactggaattaatttctcttctgggctcccacagcactctgtatttttctaatagcataacactattttgtttgtagatatttctctgatagcattactatctttcctctttatcacaactgtttgaagttcttttgcctcttgcatccactgttgcccaatcccactgctggaaggctcatcttattaagttctgtattcctagtgctaacacactgtctaccatagatgatgttcaataaatggttgctaaatgaattctcttgtgataatagcactatggcaacataatcgacggtaaaaatttcttctcaatgtttacttttagcagaatgcattcatttatcaactttcattgagaatatgctaatttccatgaccctgctaggaaataggaaaataaagatgaatgtaataaggtgctcattctactgaaagtcttgactagtggagaattatggatccaacttttcatgaaatgccttcagtggtaagaattctcatatttggaataaaaaatgttatgggttgtgccaagatacctacatacttcataattttgtagagggctgtccttactgcagaaatgtatactactatagtcatatgtggaaattctttttatgatgctaactgcatgctaaccagactttttaatttaatacttgcattaaataaaccatgctaggaatccaggaatctagcttggtttattttccatacaatgtactctttgtaatatgcatatactacataaaaattctattaatggcctcgtactaaagatgtgtctgttggggaatcagttattctgtataattttatcttaattgatatattaaaatctaccaaaaatataaactccgagtaaaagtatctgcatggtgtgcatatgtttattattttaagtgtcagcgtatacattttcatgccataaagttataaaatgaaaaaatagtagccttttatattaagttcatgcttatgtagttagtaaaaacaagaaagcaattaacatacaaaccatgatggtggttaaacttgcttcagtttgtgttttttaaaatttgaaagtgagaaatacagctcgaagtcagctcatattttcagtaagtactgatgaggatgtactggccctattgactacgctgaccccattaaaatatttgtgagtctaaaggttcatatgacgctgttccttcactctagcaacaggccatacatgtcttacatagggactctgttcaattcattaatacctcctgaagtgctcaacatcgtggttcatttatagtagatactcaatacatactccattaactgaattctaagataaactgtctgttactgacagaaattttcacttaagggagtctccgtggctgaaggcaattttgaaatcctgtaaaagaacccactcctctccccaagtaatgaagtttgtcagtttcaagcctgtaataaggtactgacttaaaattaattttctaataatacagtactgctatgtatctaatgtggggttagtcaatgataggaaaaaaacataagacagagtcacatttaaaaatgtgtgcttaggtgcatggtgacacctgcctgtagtccagctattccaggggctgaggcaggaagatcccttgagctcacgagtttgaggctgcagtaagccactgcactcagcctgggcaacagagtgagaccctgtctctaaaaaaaattcgttttaagtgtgctcaggacataacaggagccgctggtaacatgccatttccactgtgaatatggtaaggacagaatccctgtctctaggccctcttccactagtcaatctcatcatcaccatcaaggccaacattggtattctctcctctgagacaaagtctttgacattttctatactatactatgtcttcctctccccaaatgcatatacaaataaaatttgaatgcttctttctccatttagtgtaattttttttataacatagacccaattttcaaaccccacaatggtggattttatttgatgtattgtaaaaagcgctggattgaagtcaaatggcttgggagacctaaattctactcctgcctgtaccatgaaagagacaaatcccaaggctttgcagggcttcagcttccttgtttgtagaataaagaattataaaatcatctcttttggtcctactgggcaataaaaagctatgattctaagcctgttcccttttctcacctaagaatacaaatttgatacaaagaggccgcagaatgtgtcaaacactccctgttgcctggaattctctcttcctttgggttcagggataaaggtatgttatttcttaagtctccctttgctttcttctgcttgcctcgtaaatatttttccatcttggcagtcctacatgtcttctcactctacatgttttccctaggtgatgtgacccagcctgtggcttccactgccatccacacacgtcgctgcctctctccacatcagcatcgcaactatctcctggaagctttccaagtgctgaactacagtaacctcaaccgaactgctgttcattcaccccacaggcttgcccctcctctgcatctttgtgagaacctgagagtcatcctaaactcctccttccacctcactccccacatcaaatcgattaccaacttgtgctgattttatcttcaaatactctccagaattgtcgctgtcatggactgaatatttgtgttcccccaaattcatatgtcctaatccctgatgtgactgtatttagagacgtgacctctaaggagtaattaaggttcagtgaggtcaaaggtggagccctgatctgataggatcagtgtccttataagaagagactagagctgggcacaggggctcacacctgtaatcccagtattttgggaggctgaggtgggaagatcactcaaggagaggagtctgagaccagcctgggcaacagagtgagactccatctctacaagaaaataaaatagtcagacacagtggtacacacctgtggtcccagctcctcaggaggctgaggcaggaggatggcttgagcccaggaatttgaggctgcagcaagctatgatcacacctctgcactccagcctgggtgacagcatgagacccagtctctttaaaaaaaaaaaaaaaaaaggccatatatagcccagaagagcgtcctcaccaaaacccaatcctgatagcacctggaggacttccagcctccagagctgtgagaaaatttctgttgcttgcaccgcccagtctgtggtattttgctgtggcagcccaagctgactcatcagtgaccttctctctgttaccgcagagtagctcatcatcctctcttccctagagtccagccactctctcacatctacctacctagcagtatcactgtgggttagagtcagatcactgcggattaagtcctcattctgccactgcctgtgtaaatctgagcaagttacttaatctctctgtgtgtcagtaacctccctgtgaaatgaggctaataatagcagggttgtttcaacaaggcgatacatgcataatgcttacaacacagcttggcacattataagcattcaacgaaaagtgagctactattatctcatccgttatcagaataaaccacctaagccacaaggctgcccacatcatcctcatgttttaaaacacttcagtgggctccccaccatcaacaggataaagtccaagcttccttagcatttcttagaggctccatatgaatccccaagttccactacaggaacacaggtgaactttccactccaacctcaggctccttcgtgtcactcctcatccacatggaggtaagcagcaagagactccgtgcagttcctggtggttccctgaccctcaggcagactctccccagccctctgcctgcaacgtccttgccctttgcttcccttggccagctcccattcattctccttgattctgcttggaagtttccctctcaggaaggctttatgaaccttagtgtaggttatgaacccatctttgctcctttcataccttttgcaagcctttatttattatgacacttaaccattatcatactgaagtgacctgttggtgtgtctttgttccccactagacagaaaactcaagatcagagaccagttcttgttctttttttttttttttttttttttttttgtatcacagtgtttagcagcctgctatatggtaaatgtcagtaaatgttccacaaactgaatggaattgagctctggaatctagaccatcttttccatacccatcactcctgtcttagttgaagtccttatttcccatttgaagcaatgcaaaggatttcctaactctaatctctcttttcttcacaccatcctttaaacagccgacagaatggtcatcctaaagcacatatatcctatcttacatatcctagattcggaacctctctgggcttctcaccatataagaagaaagtctaacctccttagcaaggtgcataggtcttcaatgggctccacctcacttctctatatatacctatactcttgctacactaaacttctttcttactgttgctggaacaagttcaacgctttcaaacctccctgactttgcatatgcagttcattctgtcaggaatgcccttctctcttatgcctgggatattctcattcattccatatgacctatttcataagtcactccttaatgaagcctttcttagatatccactggggcaatcagctgcttgctcctgtttccacagcacattgttcacacagatagcacaggacttaccacaagttattataattttgtctgtcttgcccatttgaatccaagggcaaggacggaatcattctcatctttgtatgtcctgggaactagaactgtacctgagacataataaacacttgatatgtttgtaatttttaaataagttaatgaacggaatggctagaaaaagtgagaagaaactctggcttactgtatatcatactgtcatactaaaaatatatactgaagacagaatcacattatatcatcacttttcacgctataggccatgatccattatgaaaaagaggatagtaaaaaaatcacagggcacaatttttgtttctgtcacacacatgtgtacctgtatattggactggaatgtaaaacgcatgttccattgtagaacgtggttttaaaagaggcttggaaaacactgcatatggtcatttcttagtttagtacaatttattattttcgtaataacctcagctataatataagtctaccatgaagcattttggggagattaaatgagatgtgaaaagtaaatgtgttagatagactgaattcatatcatagcttgctctgatactttacaaaacatttaaccttacccacaagttttagtttcctcactaaagtcaccctgaggacagtaatgggatcttcctcacagagtattgtgaggaatacataagagaacgtacgtaaatgcctggcacttagtatttattcaataaatcttagcaatgatgatgataacaacatggtacctggcacataagagagttaaaaattagtttcttcagtcaaatgtgcttacattgatagttgatactaactggggttaaaaggtcattgctggcatctcagaaagatagattacagtgaaataaaaaatgactactgcttaaaatgaatgaagacttatttacaaagtcatgttcatctggtacaataatgaagtcgctcaattgggagaaaatgacaaataatacaagtgaatatacaatcttacttaagacgaaagaaataggacaccaggctaactatcagtctcctaaaccacaactttatttctgatacaaagagacagtgagacaatcagggcttccctcaaataaattacttaatctctcttcaattcagttttgcatctgtaaatataaataactacaatttcacagtatttccatttaaaaagttctagtgcaacatcagaaacaagaacttagtaggtgttcaaaaagaaatataagttctgctttgttagccagcaaatagttgcctgtttctagccctcacttcttttctcctaaatccctatattgcatttatttaacttaaagtgctggatgtggcactacgagaaagaaaaagatatttggtaatcttgttaaaatcattagacatcccaggctatctggaatcaccttgggctcacagttagacatcagctatggcttgttttatttaaaaattcatccactgatgcatgataatggaattcacaggagagcaatttaccaaaaaaaagaaatttattgatttataatgtgagatattaatttagccacaaatatttattgagcatctcctacatgccagggaatggactatatatggcaggaaaacagataccaatcatttatatcaggcatttttttctaatagaaggatattcgcaggagacaatgcatagcaccatgccttgcacgtaacagacatttaataactattagttgaataaaattggagactagaatgatacataaagaggcaagaaagagcaaagataagcctttctgagaatttctatcatgttttgctcaatagcttgtctttatccactgcttgtatttttccatgtagctaatcctcattggtcgttagaattgagacaccctttccttgaaatcaggagctataggaggccattcttcctactgggcattttctttctgggacagggtctcactctgtcacctaggctggagtgcatcatagctcactataaccttgaagtcctgggctcaaggaatcctcttgccaaagaggtgggattacaggcatgagtcaccatgccagcctatttggcatttctactgtagacaaagcagacttacagcagtaggtctacctgcctaatacaaaaagaaaaaaaagaattttaacaaacaaatgagggaatcagatccagaaagtgattcttataacttagattacttagagtagatctataatctgctctagatccactgcatacagtgggcccttcttatcatattccataaatagcacttttctcagcccagcttttgatgatagctgaacagactaacagtttgtctaacaaaggctagagaaggggatagcaaataatggcccacaggctgaatcctgcctgctgctcatttttgcaaagttttattagaatacggtcatttccactcattttcacactgtcaatggctgcttttgcgctacagcagcagagctgggtggttggggcaggggtcacatggctaacaaagactaaaatacttatcatctgaccttttacagaaagtttgctgatccttggagtgtacaagtattctatattgttgattaagaacagaaccacaagtattagaagttagaccagcaggtggtaaagctgatcatctactaatataatggaaattggggttcccaatcaggactcttgctttgatagaaggccatcttaacgaggagggagacacctgcaggcaaagtcagaattttctgcaggaaaagttttgagtccatttccccttgtgaacaagtgctcagctatgcatttcatctttagtaaccatgcttctatacctggttctccttggcaaagatttctttcttcagtaagtctcaagactttctgggaaggtagggagatatgggggtaaaagtgtcccaggacttactgaaggaagtgttttatgattatctgatagaatcactgtatcatggtagagaaggcaaacagaatataatctgaaaatagaggtgagggtgaacaaatgggcactaaaagtgaactcagcatcaggaaggtagcaaaacaagacatcagtcaaagatatggggtgattcagacctaaggaagatttaatgtgggatgtttccgtgtgccaggagctggacacttaagcaagaggagatccaggaatgttgctaaaaccatggcctccatactttattggaattagcacaacttatccttgtttctttcattttgcaatcaaaatctttaaaaacacattatttaaaaatacattattttaaaagctagaatgaaaattatgatatcatttaggtggtttaaaaaacatccaccagccgggcgtggtggctcatgcctgtaatcccagcactttgggagtccgaggcgggcagatcacgaggtcaggagattgagaccatcctggctgacacggtgaaaccccgtctccactaaaaatacaaaaaattaaccgggcgtggtggcgggtgcctgtggtcccagctactcgggaggctgaggccggagaatggcatgaacccgggaggtggaggttgcagtgagctgagatcgtgccactgcactccagcctgggtgacagagcaagactccatctaaaaaaaaaaaacaaaaaccatccaccaaaatgggaagaagtgatgaaaaattacagtccaagaagaagggccatagctgtttaaatcaattggtatatttgttatctaatataaccccacgtaacgacaggtatttaacaaatgtttctgctgaatttgacgattccatttcccttacatcccatatgcaatccatcagcaccccacatccaacccatcagtacatcctgtcagcattggctcccaaatataacctaaatctaacacatatcctactatctctgctgctacaactttagtctgaaatctcataatctcccacttgtactactgtagatgactctgaatgagtcttcttgcttccattccacacagcatccatactgatctattttttttttcaattttttgtagagacggggtcttgccatgttgcccaggctggtcttgaactcctggcttcaagggatcctcccacctcaacctcccaaagtgataggatttcaagtatgagccactgtgcctaaccctgactgatctttctaagcataaatctaataatgccccttccttgattaaacccttcaatgaattcacattaagcaaacaacctggccaggtgtgatggttcatgcctgtaatctcagcactttgggagaccaagatgggaggatcacttgaggccaggagctcaacatcagcttagacaacatggtgaaactacatctctacaaaaaatacaagaattagctgggcatggtggtgcacctatagtcccagctactcgggcggctgagctgggaggatcacttgagccctggaggtcaaggcagcagtgagctgtgattatgccactacacttcagcctggatgaagtgagacctggtctccaaaaaaaaaaaaaaaaaaaaaaagaagcagggcaaggtggctcacacctgtaatcccatcactttgggaggccaaggcaggcctcctggatcatgaggtcaagagatcgagaccatcctggccaacatggtgaaaccccatctctactaaaaatacaaaaattagctgggcatggtggcatgcacctgtagtctcaggtacttgggaggctgaggcaggagaattgcttgaacccgggaggcgaaggttgcagtgagccaagattgcctggtgacagagcgagcgagactctgtctcaaaaaaaaaaaaaaaaagaaagaaagaaagaaagaaagaaagaagaaatccttagtcctgtcttaactacttgagaggctgagggaggaggatcacttgaacctaggaatttgaggctccagtgagctatgacagcaccacggtgctctggtctggagagagtgagaccttgtctctaaagaagagaaaagaaaagaatgaatgaatgaacaaaaagaaagaaggaaaggaaaagaagagagagagagagagaggaagaaaggaaggaaggaaacaaaataaaataaaataataaataaataaacccaaatccaacttctttaccctaatcaacaaggctcaaataatctcatgccaactaagtctctgaacagctccttccattctattgccagattactccatctttcagccacaagacctttttatcttccttttaccagccaaacacaatcctacctcagaacatgtgcactttttcttttctctgacttgaatctcctccacccattatataatcttagctcaaagaggcttttcttgacaacttagcgaaagtatttatcccagtcattctctgctacattattccaatttattttctccatagtacatttcagcacataaagatttccttagtatgtgcttgttgcctttccccaacctcctaaaatgtcagcattccttgagggcagagactgtttcattcctgtatcatcagcacctaagacagttcctggaacataccaagtacttaataaaaatttgtttattgactagctatgacacattttacttatataatttcattttctcagcaaaatgaacactttgaaatgtaattaattactgatttttgcagtattttctaattatttaaataaaatatttactattttggtcaaccagaattcttacattgttttagcacccagatagcttctaaaaatgcttacaattaacacaattttatctagcaatatgtatttatcactagacagaatgcactgaactcttcttcattaataaaaagcaatccaggctgggtgcagtggttcacgcctgtaatcctagcatagtggaaggccgaggagggaggatcacttgataccaggaattcgagaccagcctggccaacatggcaaaaccccatctctataaaaaacacaaaaattagctgggtataatagcagacatctatagtcccagctactcaggaggctgagaggtgggaggactgcttgaccccaggagattgaggttgcagtgagccgtgattgtgtcactgcactccagcctgggctacagaatgatacctcatctaaaaaaaaaaaaaaattagccaggcatggtggcatgcacctgtagtcccagctactcaggaggctaaggtgggagggtcacctgagcctggaaggtagagactgcagtgagccctgggtagcccgcgccactgcactccagccctgagtgacagagacccagtttcaaaaaaacacaaaaaacagaaaacaaaacaaacaaacaaaaaaacccaatgcattgctgaaatgttaaatccattataaagaaaagtacaggggtgggcatggtggttcatgcttgtaatcccagcactttgggaggccaaggtgggcagatcacttaaggtcaggaattcaagaacagcctggctaacacagtgaaaaatgcaaaatacaaaataagccgggagtggtggcgcatgcctgtaatcccagctactcgggaggctgaggggggagaatcgcttgaacctgggaggtggaggttgcagtcagccaagatcgaactccagcctgggtaacagagactccatctcaaaaaaaaaaagtaaaaagtatatagttgattctgcagggacttaaaaaagtataaatatcttttttaacatcacaaagctctgatatctgcaggtttatgactaactactagctcactcccatgaatacacgtatgtaaacaggctctatacaatctacaatcccagactaaggggaaaaaactgtcctgtcactgtggtctccaacccttggcccatttctttcctcttgaccacaaaacttctcaggagttgcttgtttcctcttgatccacttatctttagcccactccaatctggcatcggttctcagtactctccactaaaactgcttttatgaaggccatcaatgacgttcatgctgccaaatccagcagacacctcctgttttctaattttttttattgttattttttaagagactgggtcttgctctgtcacccaggctggaatgcagtgatgccatcatagctcactgcagccttaacctccctgagttcaagagatccttctacctcagctgggactacaggcatgcacagctatgcctggctaattactcaatctttaacatagctgataattccctccttgaaacactctcaacttttaagaaaccctgttattttcctcctacatttttagccagttcttctatcagcttctccttatctgacctctaaatgttaagaacattaacaaagactgaacctagtttttttctccccttactgtactgctcctgggcgatgtcaatcagtcccattgctttagatactatctgttgaaacactgaaatcactggttttttttgttttttttttttttttttttttttttgagatggagtttcgctctgttgcccaggctggagtgcagtggtgcaatctcggctcactgcaagttccacctcctgggctcaagcaattttcctgcctcagtctcccgagtactgggattacaggtgtgtgccaccatacccagctaatttttctattttagtagagatggggtttcaccatgtgtccaggctggtcttaaactcctgacctcaggtgatctgcccaccttggcctcccaaaggttgggaaaagatatcccaatctttttcctatgatttcttaattgatctacttgacatatccacttggacttttaataggcatctcaaacttaatgtgttcaaaataaacctcgtgactttccctcccaaacctgtccctacctccctcaataactaatattatcattcttatattcatatattgaataaatgtttgttcccccaagtatttgttgctataaatttatgaagaattcttttctcactagttattataattaaaatgtaatatttattttctttaaaaactttactttgtaggattattattttttaaacagggaccaacaataaataacttctctacttgattaaaactagggcttcctcttgtgctccctcaggactatttctttgtaaaaacaataggctaaatcagtactggtgtcaaagaaatcataatctcacaactttataaatacagcatgtggcaagggattttcccatcttatatagtaataaaattttcagctgtgccatggctaaaagtttaccatcaaagttggaattttaaattagaggtagtcatctttctttctttttaaagaaatggagtctcactatgttgcccaggctggagtgcagtggctatttgcaggcatgaccacagcacgctacagcatcctggcctcaagcaattctcctgcctcagcttgccaagtagctgggactacaggtccctgccaccacacccagcagaaatatttagctttctgaatttctcaagtgtgtgtatgaatgagactagtggggtccttaaccaagattcacaggatttttagtgatttattaaataacttggatttgtatctaccagcatgttctttgaggtacaggtatgtcttttatatctcctaatatagttcattacaatgctaaatactaagatgtgatgctcacacactacagaatagccaagcaaatgaactacttattctcatagggctattataattaacaaattcttgtatcaccccatcattatcaacaacaacatgataggatttccttttatcttgaagagtctggaaaaagggtaacagagagatatttctgaggaacaaactggtaatgagggagctactgtgtccattacaatactccttctagaagctcaatacataatgactaatctctggaaaaaagcaagtgtgagaatggaaggctcttcttcaaactatgcaaaatgaatcaatcagcagtgaacaaatttatgagccaaacaaattcctacaaaaattaccatcatatgctgtcatgcatgtctgccagtctatttatcatattatttaagaaacaaacatttattgaagatttatcatgtgctcagcactgccaaagaggaaataaagagcataatatctattcttagaaaataacattaacacaaatagaaaacaagaaaccataatgttaaaaatattacatagtaacacagaaagacaatgtataattatacatacgcactaaagcaaagataacataatttataaattatgaggtacagaatagttagattctgaaaattaaaataatcaggaaaaacttcatgaagatgagatctgggctggatcccaaaggataggcaggtggatcatgtagaacaggggaaaggagttcctgatcggggatacaatatatgtaaaaactcggagacaggactgagcgtgaaatgttaatgggacagtaaagaaatcttcctctgcagcgggggaaaaaacagaataatgggaaactgcatggttaaaaggtttgatgttaagatagtgcttggacacaaaagatcttaaagttgagtcaaaagagtacaatgaaagcattagaaatagaagataaaacacaattaggccgggtgcagcggctcatgcctgtaatcccagcactttgggaggccaaggtgggtagatcacttgaggtcaagagtttgagaccagcctggccaacatggtgaaaccccgtctctactaaaaatacagaaattagccgtgaatgatggctcgtgcctgtagtcccagctatttgggaggctgaggcaggagactcgcttgaatctgggaggcggaggttgcagtgagccgacatcgcgccactgcactccagcctgggtgacagagcaagcctctgtttaaaaaaaaacggtaaaaataaataacatttactattgttttctgatgatatatatggcctctaattgtaaagctgaatgcctagtttaccactttttttttttttttgagacggagtcttgctcttgttgcccaggctggagggcaatggcacgatcttggctcaccacaacctctgtctcccaggtttaagcgattctccagcctcagcctcccgagtagctgggattacaggcatgtgccatcatgctcagctaattttgtatttttagtagagatggggtttctccatgttggtcaggctggtctcaaactcccaacctcaggtgatccacccgcctcagcctcccaaagggctgggattacaggcgtgaaccaccgcgcccggcctatcattcttattttatgcattaggaaactaaggctcaacaagattaaagctgtctagggtcacaaagattgtaagtggaggggctagaattcaaaatgagacctgcttgactcctaagcctgtaccatttctactatatttagagtgaagtagatgggttgaagaaatatttaggaggtgaaatttcaaaagtgtacagtcagaagagaagacatatatggaaacctaaattttcacacagtaaagtgtcaataataaaggcataatgccaaaatgacagaggctgtgcatggtggctcatgcctgtaatcccagcactctgggaggctgaggcaggaagatcacttgagcccaggagtttgacaccaacctggccaacacagcgaaaccccatctctactaaaaatacaaaaaattagctggtaatggtggtacacacctgtaatcccagctactcaggaggctgaggcattagagtcacttgaacctgggaggcagaggttgccatgagccaagattgtgccactgcactctagcctgggcaacagagtgagactctgtctcaaaaaaaaaaaaaggaagactcgagggctagaaccctgaaattgggaatgaacaggactggctgaaaatgtttcttgcacctgataaaaatcttgaagaagaatgctttaaatagataagaaaggagagagagaggtgggcagtgagaggagaccaccctaagtaatcagagattacttacgttggttactcaggctggtctctgaatctgattataaatgaaatagagattacttaaaacaaagggctgtaaggtagcactgtccagcagcactttctatgatggaaatcttctatatctgcactgtccaataaggtgtagctgctagcacatgtggccactgagtacttagaatatagctacgacaaccgagaggctgaattttaaatttaatttaatgaattcaaacaaatttatttttaatacagcactttaaattttatttttaaattttaatctattatttatttagagactgggttatgagactggctaatttttgtatttttggtagagacggcgtttcaccatgttgcccaagttagtctcaaactcccgggctcaagtgatccacctgccttggcctccccgcaaagtgctgagaatacaggtgtgagtcaccacgcccggcctaaacttaaatttaaatagccacgtgcgggtagtggctaccatactgcacatgcaactgtaagatgtagaagtcagatgtgagcaaagaaatgacaagccgttcaatgctgttagagaatgaaattcaaggttccaatgatctgaacttgtgtcccctcaaattcgtatgttgaaatcttaatcctcaatgcaacagtattaagaatttggggctttaggaggtaatttggttttgagggtggagccctcatgaataggatgagcacctgaggtagcctctttgacccttccaccatgtgaggacacaccacgaaggcaccatgttggaagcagagagtgagcactcccaagacactgaatctgccacatcttgattttgggcttctcagcctacagaactgtgagcaataaatatctgctgtttataaattatccagtgtaaagtattttgttatagcagcctgaatagactaagacaaaggtggactaaggcaggataacaggttagaaaaggaggcagggcctttttttttttttttttttttttgagacaaagcctcactctcacccaggctggagtgcaatggcatgatcttggctcactgcaacctccacctccagggttcaagcaattctcctgtctcagcctcccaagtagctgggattacaggtgtgcaccatcacacccagctaatcttttgtatttttagtagagacggggtttcactatgttggccaggctagtcttgaactcttgaccttaaatgatccacccgcctcggcctcccaaagtgctgggattacaggtgtgaaccatcgcgcctggccgaggcacagtgtttttacagagaagcctgtttaaggtttaatcatataaaatgtatgatatccagtaagttttgatataaaaaagaaacacctggcgattttatataatatattgtgctaaggaattttaagcactctacattctgctctctaagctctgtaaagagcaccagggattttttttttttttttctttttgaacagggtcttgctctgtcagccaggctggagtgcagtggcacaatcttggctcactgcaacctctgcctctcgggctcagcgattctcccacctcagcctcctgagtggttgggaccacaggcgcatgccactacatctggctaattttttgtagagatggggttttgccatgttgcccaggctggtctttaactcctgggctcaagcgatcctcccaccttggcctaccacgcatgcctggccacaacagggatttttaaatgtaagactacctagtcaactcttattctatattaacaatatagacaagaaataacctctaagtaatctctatttcatttataatcagattcagaggttctcttatgctttacaatattgtcctactgtgggtagcgcaataactaaggtaatctgaaagaccagttatattatatactatagttaaatgcatttcaactgcatgggagaaagcaactgtgttctttcctctcaattttaacagaaggaaaattgtcaaaattagcttatttagaatgtcctatcagagaattattttgattaaaatatatttttaatcaataaaatatttctctttggtcaatacttgtcaatatagaataatatctagccacaaaattaaaaaaaaaacattttcccctatattacattcatggatcttcttgaatttctgttatctaggtgcttttaaaagtcatatttctgataatatgaaatcacagctccttttctttggcatatttagttactgtattaagaaaatgtacaacacataatttagaatgggtaattattatattctctttattcttatattgaaaatgacatgaaaattaccagtcttcccaggtaatataatttaagttaaagaacatctacatactacaaccaatacccattcccctatgttatgtttggaaaaacatagaagtatctttagtagtactcttagaaattatcccaggttcagcatattggtattttatttccaggtttaagttacagtattttgggcaccccaagtttaataaactattccctgcagaaacctgacaagtgaagttgtggctgggaatatgttagtcttcagataaaatgaattgtttaagaatttgctaaagatctcaaagcatctttcttaaatctaaagaaagtcaggaacaaagccacaaccaggaccatagcatcagaagatggaaagttgctttgtcttcaaacttaaaaaacattttccattttaaaataattttactatttacctgtgatactgttgaaaattatgaaaaaacagataatttaaaatttagtgcttttttttaaaaaaaaaaaaaaagcgaatccctgggacacttcatatagtgcaaaacaacaattcaagaattcaagcattgaaagaaataatctcttatcccccagtctctgaaagggattgcctttactactgttcccatctttatgtccatatgtacctaaggcttatctcccacttacaagtgagaaactattcagtatggcttagtcatttttaatgcaagagaataggtaaaaatgccaagcaccagccagagttttttctttgcagatagatgtgactcttacaggagcagcagggatttcccactttgggcggaaagcagcatttaggtattccccctccagtgcagttacagaccacccccccgtagaagctgctcctgtcctctgtggcatgtcagcctctgattatcttttaataaacaatatggcatattaagtctcttttatgcccttctttgtattcccaggtaccacctccatgtcaggataacaagaatttggtaatgtttgttgaataaatttagcagaagttgaaagaaaaatcctgtttctacagaaagataccactggcttttggggagcccgagttcatgatgaaactaaagaaagccacaaaagttcacctcaatgccaagacatttcttgatttttgaaaacccagttgtcgaaccacccatctatagaaacttgaaagactaaaaactatcttactctaaacattttctaggaagttgattctacaacacattttggttttccaatttggcttctaataattatttcaaagtttctgtggcctaaattttgttttacattgatcctttgaatggactactgtttccacattttagaacatttaaaaagatatctacaacccgagtctaatcataaaaaaaatcagacagatccaaaatgtggaacattccactaaaaaaggagtggggagaggtctttattcttccaaaaatatcaatgccataaaagacaaagacggctatggaaatgttacagattgaaggagactaaagttaaatgcaagaaaggaaaaaatggcatataggacagtattgaattgactgacaaaactggattacaatagtagagtatcaatgttaaacttgctgaagttgctaactgtatttcttaggaattattcacctaagaatttaggcacacagatatgatgtatgtaagttacccttaaatggcttagaaaaaaatgtgtgtatattcatttacatacgtatctacacacacgtgtattagcggaagagagcaaggcacacatgtgcataagtgataaagcaaatgagatgaaatctttatttttaaatttaattttgtaagtttcagctttttaaaattttagattccggggatacacgtgcagttattacttgggtatattgtgtgaagctgaggtttggacctctaatgttcctgttgccacaacagtgaacacagtacccagcacgcagtttttcagcccttgccccctccctcccgctctccctccttgcttttggagttcccagtgtctactgttcccatctttatgtccatgtgtacccaagacttatctcccacttacaagtgagagcatgcagtatttagttttcttgttctgcgttagttccgttaggataattgcctccagttacattcatgtcactgcaaaggatttgatttcattctttttaatggctgtgtagtattccatgttgtataggtaacacattttctttatccactcatcaattaatgggcacttacattgatttcatgtgtttgctattgtgaacggtgctgcaatgaacatctgagcgcaggtgtctttctggcagaatgatttattttcctgtgggtatatacccagtaatgggattgctagctcagataagtatttctatttttagttgctctccacaggggtagaactaatttgcattcccaccaacggcgtgtaagtgttcccttttctccacggcctcgccaacatacgttcttttctgatttttaatagtagccattttgaactggtaagagatggtgtctcattgtagtttggctttgcatccaaatgagacaaaatcttaatgacaggtgaatctaggtaaaaggcatacagacgttctttgtgttgtttttttaacttacatttgaagttattttcaaatgaaaaataaaagcaagcaaaaaaaggtcattcttcatctagtaaactcttcaaagattaccacccccttcaacagtttttcctggttctagtgagtcttctcccatttgtttagatctttgttgaaatgtagtctcagataaaaaattgtatttttatttcttttacatatttcaaacaatctaaattctttttaaatgaaactcattaaaaatactgcatttgtttctaaataaaatggtagaggtaatttgcacctttccaaacagaagcaataggagcaacccagatgttctagccacgatccaagtcaaccacattcaatctaagaagtaattgaaggctgtaacgacttctgtaaggcctacaaaaatgagttcagacacaagctctgctcagtaaaaatctagtggcagatgatatatacaatgatctgagaaaaaggcagaatcaacaaaggttgtatttttatctattgctgcgtagcatatttccttaactttagtagcttgaaacaataaacatttattatttcataaagtttctgtggtcagaaatccaggagcagcttaactgggtggatctggctcagctgtagacaagatgtcggctgggacggccatcctttgagggctctgagggctttgagggctgcacgatccaattgcaaggtggctcactcacatactaggcaagttactgctgggtgctgggaggagaccttagtttcttatcacatggacctctccacagggctgctggaatgtcctcatgaccttccccatagtgagtattccaagacaggaaagtggaagccacaatgtctttcatgacctagcctcaaaagtgacatactgtcatttacacaatattctactggctgtacaagttaatcctatttagtctgggaggggactgcataagggcatgagtaacaagaggcaagaatccttgggggccatcttggaagctggctacacagaagagaaaacaccaggggagtgcgaagaaggtgcaattaaactcaattccttggtatgccaatggtaagaaatattaggtgatctctggggtgtaacctttttaatttagttcttcactgaataatctggccagtaattgtaatacaaaatacggcactctgacaatattctctccctttataatcaattacacaccagaatatatataaagaaagacttacaaagtcacaagtaattgtttggtattatttttataatcacatactagggccctacaattagcattcacaaacatcactccatgttggccagataagtctgtctttatagtggtttaccatacgcgccttagcatgaagttacatgtggtttccttagccatcagatgctccaaatgcaaaaaatgtctcaccacagtcacagaatcatggaatcctaaagttacctggggtttctgaaaatctcatgggaacaactcacgagaattaaggcttaagaaagtgatttatcaaagaacaaaaccagcaagacttgagtttagaactcgcagcagagttgtgactagaacctgttgaaataggcaatgtagaaacccagactaaggcacattctctacaactttactatgcaagtatgcttagatactccttagcaaacagcaggccttgagtaaattctttcagaactgaatacacaaaggatacagaacggaatacactaacaatagtgcatgatgtgctcatttctgtaatagaaatgaattaattctgatccatctataatttattattgctccatgattaacggaaggcataggaaagatgactggaatagtgtaactagtacaaacaagtattacacttgactgaacctcattacactgcaattgcatattatatagtatgtaggtgaacaaatactgggttagtcagtggacctacatttgaatactggttctgctcctagacagctgtatgatttgaatgacttctttatactttcatagtttctctgttcttctctgtaaaacaaaggcttagaagatattatgggttagattatgccccttacaaaagatgctgaagtcctaaactacaatacctgtgaatgtgactttatttggaaatagggtctttgcaagtgataaagaagaggtcatggagtgacctaatccaatacgaccagtgtccttataaaaaaaaggaaatttggatacagatacacacaaacaaggagaatatcaaatgaacatgaaggcagagaccggggcggtacatctacaagccaagggacaccaaagattttcagcaaatcaccagaagttaggaagagtcatgggacaggttctcacagtcctcagaagaaacccaccatgtcaatacatcattttggacttctagtcttcagaaccgtaagaaaataaatttttgttgttcaagctacccaatttgtggtactttgttacagcagtcctagcaaactaatacaaatgagctcttaacactggtctaaaataggataatcctatgaaatgctacaaatgtttgggaagatttctcatactcaactgtttacagtataccacaagcctgtcagttgaagatacaaacagaccctctataatcctctatacttatatgcaaggaacagcacactttttctgcaaaaggtcagatagtaaacattttaggctttgtgggccaaacaaggtttctgttacattttttttttataactccttaaaaatgtaaaaatcaccctcatcccaacggactacaggaacagacctcaggtcacatttgactcatagcctgacccctggtgtgtagggttaacaagcctcctttccctgggctcctttttctttcagcattccaagccaaaggaaactatctttttcaaatcattttctctcctaggtgggacatcttacaccagcccaggcatgcttccgatagccttagagtagctgtcccttcctcagaattactgtctaattggctagaagttagcaactttttacatttttccttcaattcctttccattaagaagaaggcatgcaccggcaaattacttgtgactatcaatgacatactctcagaagcaccagtacccctgtgttgtttctaaacccattctaatagacacataccccaaggttatgctgtttgtcatctcacaaaatgacttacatctagagatttaaataattaatgtacttttcataactaccaggtacagtagatctgataatggcagagctaagcacatatacagaaagtagggcaagggccagagactcattttaaagcaatgttacaagatcgtcactgttgcttttcatttttctaaatgtggccactgctgttttctcactaaaggaaatgttttatgtaaagtgaataacagtacctggcataaaataagtgctcaataaatgttaaggccttctctccctcttcaactggcctcctcatttttcacaaagtgaaatagaaaaacaacatggaagataatcctgttgcttaggaaaaataactaaagcttgctagacaaaatacacctgaaaatataggaagtgagctatagctggcctatatgcatgtatgttggaacaggacaagatagtgtagggtggggtgaagaggacagagaaatggaaggaaaggggctacagccttggtggcaaaataaaggataagacgactcttttaaaatggtctatttcaaatgctgggttgtgaaacttaatttgattacttcatgagaaacagcatctataatccatccctgatttttctacaacaaaaatttattatttattttatgtttgtgtgtagatcttttatatatatacatgtacacacgtatatgtatatattatatatgcatatgcatatatatgtgtatatacatatataatatattgtgtgtgtatgtgtgtgtatatataatttttttaaaggaatggggtctcactatgttgcccaggctggacttgaactcctgggctcaagcaatcctccacctcagcctcccaagtagcaaccaacagttttagttttgaaaaaataacaaatattaaacacccatgtgtaagggttggtactgggccctgtgttagtttgcatgggctgtcgtaacgtaacactacaggccgggcacaacggctcacgcctgtaatcccagtactttatgaggccaaggtgggcggatcacctgaggtcaggagtttgagaccagtctgaccaacatggagaaaccccgtctctactaaaaatacaaaattagccatgtgtggtggctcatgcctgtaatcccagctacttgggagactgaggcaggagaatcgcttgaacctgggaggcggaggttgtgatgagctgagatcaggccattgtactccagcctgggcaacaagagcaaaactctgtctcaaaaacaaaaaaacaaaaacaaaaaaaccctgataacactacagactgggtagctggaccaacagaaatttattttctcacagttctggaggctggaaatctaagataaagttgttggctggtttggtttctgaggcctctctccttaacttgcagatggctgctttcttgaaatgtcctcacatagctgtccctctgtctgtttctggtgtctccccacgtatccaaatttcctcttcttataaagatactagtcatattggattagggtccaccataaagacctcatttaaacttaatcacctttttacggccctgtgtccaaatacagtcacattccgagttccaggggattagggcttcaacctatgaattgggggtggggcacaattcagcccgtaacaggcctagaccttaatttgtcaacactacagttagatttatagtatagtaactgcatctgtgctcatctaaatgtcatacccaaatgaaataatatagcatgatgatctgaatttattaaaggcaatttttcctatagaaacccaaatctataaattatatacaaactgtggtaagttactcgataccttgccaggactcatctatggtggtagatagaccacaaagagtaccactgaaagatccctttcctaatcacagtttcctcactggcttgccacaaaacctaaaattcttctattctttcattggcaatttatttcccctgaaaatgtaaataatctctggcagagcaatctattaagtgatcatcagccactaacaccttagggtagaacagctcagatcacagtcttaaaataaattccatcagtatgaaattttctttattactgctccgctactggaatgttagatcactgtctgctttaataataattctggtgtaggtcattcaaattttgtttaagataataagacaaatagcaggtataaaaacattccgtcatctaataaagcaacccgagaacagtaagaagaacgtgatgaaattaacatttttgagtacctgctaggaatcaagtattctgctagatattttagaaatcatctcaattcaatcctaaaaattattctgtataatagtataggttgagtattcctaatccaaaaatctgaagctttttttttcctgagacggagttttgctcttgttgaccaggctggagtgcaatggcgcaatcctgactcactgcaacctccgcctcctgggttcaagtgattagggatactcaactggctaaatataatgcaaatatttcaaaatctgaaaaaacccaaatctgaaacacttctggtcccaaacatttcaggcaagggacactcaagttgtattaatcccattttacagaagaagaaacaggctcagataaatgaacatctcagagcttgttgatagcaaaggagagattgaaactgtcaggcctctgatcccaagccaagccatcacttcccctgtgacttgcatgtatacatccagatggcctgaagtaactgaagatccacaaaagaagtaaaaataaccttaactaatgacattctaccactgtgatttgtttctgccccaccctcactgatcaatgtactttgtaatctccgccacccttaagaaggttctttataatttcccccacccttaagaaggttctttgtaattctccccacccttgagaatgtaatttgtgagatccaccgctgcccgcaaaacattgctcttaacttcaccacctatcccaaaacctataagaagtaatgataatccaccaccctttgctgactctcttttctgactcagcccgcctgcacccaggtgaaataaatagccatgttgctcacacaaagcctgtttggtgtctcttcacatggacacgcatgaaagaaaccctacctggttctgtgtcttacctgttgggggcctgtggtcaaactactagtacggagttttagtgtcctcactttaaaaatgagggttgtggccgggcgcggtggctcacgcctgtaatcccagcactttgggaggccgaggcgggcggatcacgaggtcaagagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaaaaatgagggttgtaaggtaactacctactttttatagcattgtagtgaagttgaaatgaattaatccacatatattatagtgtggtagaatgcagcagaactgatgatgtatgacttctaagactagtccttaagagacctgcagtttttgcttttgccctcttggaacactcctgttgccatgttaagaaaaactctggggagactatgaaggaagagagcatactcggggcaggggggtgaacaggacgtgcacatgtacgagcgtacaagccaggtgacaccagtaccacagcctcagacatgtcaccggggataccagcaccacagcctcagacatgtcaccggggacaccagcaccacagcctcagacatgtcaccggggacaccagcaccacggcctcagacatgtcacccagggacaccagcaccagcaccacagcctcagacatgtcatcggggacaccagccccatggtctcagacatgtccctgaggcccacttagacccttcaaccccagcccagctgctaactgactacagccacatgaacagaaccaggtgagaccagaggaaacttccagtcacctaccagatcatgacaaataataaacgatgttttttaaaccacaaagatttggagcagcatttgttacacaaaattagacaactattacagttcgactaaaaacatgttcatttacaatactaaattagaagtgtaagaatgggagaaaaacttcatactttaaaagtcattttttcctccaaaaacttccaactttgaaaaactgatttttataatgcataaaaattaaaataaccttagaatttatatgagtagcatagccagctggctttattatctgttgtactcaacacttcaataatcactgatgttttagaactcttcagatttagaactcttgcccttgctttagtctggtttaagctaaataattgttcttcctcaagaacaaatgaccttacctcgttttgttttccttgtctgagagaaacacattagcagtctcccatcttgtttttccttttcctgtcacccaggacagagggcagtggtgtgatcacagctctgcagcacgacttccccaggttcaggtgatcctcccacctcagcctcccaaggagctgggaccacaggcacatgccaccacgtccagcttaattttgtatttttttggtagagatcaggttttgccttattgccccaagctgatcttgaattcctgggctgaagcaatctgcctgccctggcctctccaagtgttaggattacaggtataagccaccgtgcagccttatattttgttttaaattttcctctgtatttttctctctggcaaattgtttagggagtttctttagtttatcagactaaatttcaaggctttccttccaattttgacatgtaaacagtccctcatttctgcttatctagtgattattcccaaatctgtgtttacagtctagctgtctctcctgagattaagacttgtttctctaactacctgacggcagaatctcctcttggaagtatcaaggaggcagttcaaaactgaactgggcattggctccactccttctccttctctttactattaataccctttctctccttctatatgaccacactaagtcttatttaggcatcgtttcttctgggagacctttgtagaatctctgaggttatgttaacatgctaaggttttcttgacattctcagattgggttaggtgaacttttagcaacttatctttttactaaaaagtcatccctcagtatctgtggggaattggttctaggactccctaaggatatcaaaatctgcatgagcagcccaggtgagaccagcagaagcactttacagtcacctacaggatcatgacaaataataaatcatgtttaagccacaaagtcctttacataaaatggtatagtatttgcatataacctacacatcttcctgtatcctttaaatcatctctagtttataatacctcatacgatgaaaatactacgtaaatagttgttatactgtattgtttagggaataatgacaaggaaaaaagtccacgcgtgttcagaatagatgcttttttttctcgtctaatattatggatccacagttggttgaatccacagatgtggaatccatggataccaaggaacgactgtatgcattttgacaattatacttctcatcttaccatgcattcaacaaacagaacatgtaaagcggtgataatgctgtgatgaaaaataaagcaggggaagaggctgcatccatctagtggaaacgatgcccttttcaatctgcacaaagagaaaaagctgctctccaagttggggggtgggtgggtcaggtatgtaaattggtcaggaagggatctgtaggcacttacagatttgacgctaatgagatgggaagccacaggaaggttgtgaagaaaagacaagacatgatctgattcatgttttgatctgatacactggttgctagatggagaataagctgcatggcggtgagaggaagcagaaacaataggagggtaatgctataatccagtggtccataatccaatatccccccaaggaacagttcggcaatgtctggtgacatttctggctgtcacaactgttggggcggagtgctacttgcatctagcaggtagaagctagggatgctactaaacatcctacaatgcacaagacagcccttcccccaacattgctggcccaaaacgttgatagtaccaaggctgagaaactctgttataatctgtcctagaatgtagcttggattgagatggcagtggtaagagctggagaagtgcttagcttcccaatgtttttttgtttgtttgtttttgagacggagtctcgctctgtcgcccgggctggagtgcagtggcgtgatctcggctcactgcaagctctgcctcctgggttcacgccattctcccacctcagcctcccgagtagctgggactacgggcgcgtgccaccacacccagctaatttttttgtatttttagtacagacagggtttcaccatgttagccaggatggtctccatctcctgatcccgtgatccacccacctcggcctcccaaagtgctgggattgcaggcgtgagccaccgcgcccggcctgaatgtttttaaagtactggtgaccatattcgctgagggattaaatgtaaggtatgaggggaaaataggaatcagacaccagggtttactgcctgagcaatgagaagaacgacgttcctcatacggagatgaggaagaatgtggaatagcaggtaaatagcatgtgcttgctttgtttggggctgtgcagaagagactgatgggaccaacgtgctcagttctggatatattaaacttggaatgcctatttggcaccaagtgaatgtatcaggtaggcagatggataaatgagtctgaagttcaggggagaggctggggtggcaatatgaacttgggagtctccacatctgaatagtatttaaagctatacaacaggataaggtgatttaggaactaaacacaaattgagacgagatccgagcccagaggcactccgatgtttaaaaaagaggaggaaccatcaaaagatactaaggagaagccaagaagtaggagaactgagagtctgagagaatcattatactcatttgatcgactgcaacaaatgctgcttagaggtcaagcaaaatgaggactaagcaaggaccaccaggtctggcaacatggaggccaatgccgacgtggaaatgagagttttggtgggaagacaggaataaaagtctcacaggtctgaattcaagagagagaacagcagaagaagggtagaggtggtagccataaacaatgatacattctcttgaggccttttcttgcaaagctcagtgaagaaacatggttccagagagggatttttttttctctcattttacatatgcaaacatataaaaaagctgaaagaattgtttgacaaccacccttattcttaccacagattcaacatttaatgccatatgttttccctgtatgtactgtgtattgtttgaggataacttcccctctaaatatacctcggatgtatctcctaaaataagtccattctcctacatagccatagtaaccatgaacacacctaggaaaattaaaaatatattctcaaatatattatatagctgggtatattacaatttccccaatatgtgatttgcaaaccaggatcaagtcaaagtccatgcacagcatttggttgtcatgtgtctttggtctctattaataatgatgactgtttgaaaagacctgtcctatagaataaatttgactgattatgtcatgccattgaacttgtttttctattctagaaggatagttttttagggtagtgaatacatttattactcttggcacaatagtctaacatttcccaatttccttatatctctgccctttcattttcagaaaatcaattattccaagatttgtttttcatttatcatcacttattagctctgaagactcaactgagcaactttcagggtttatataccctatattcagaaaaaaactactaccatctctcatttaccctaagaattcataggagagcatgtcttaaagctgatcaataaccaaaccaaacattttattgatcatattacatttggaaagcaaaatgaatttcctaaaatttcttccctgattagcaaaatagtgcctccgaacacttgagggtgaaagttgttgtcaaatatgcctacatgactggaaattatgacatccaaatgagttcactgggtctgataataatatgctctacatgcttatgtctatgtaataaacagcttacatctggatgagaaaattgattatacaaatatttgggcttctacaactggtcactcatctgtaagtacttaaagcaacttaaaatgcaaactgacctaacaatgcttatggttagaattccaaagaatgtttaggcattgtcaggttatgttaaaacatcttctgccacaatcttcaagtgatttatcttttctgttgtgttgaatagctatagaagacaaatgaattctgcactcctgaattcaatgaacatttcaagtttcctcacttacactgtaagattacgtagcatattttaagaaataaattataatcattttatttcacttattgaacttcttttaagctttggcattagaattttaatcaaagcactgccacttgcttacagtgatggtttttaggctctttgggcctatggactatttcaatgaccttcactagccatctagtccaccttatcctaattattaccactgcaaaagaaaccctcacttgaataaatcagtagatgggcatgaggcacctcccaggagactataattattaactcatactaaaatcaaaattgtagctattatcactcatatggtttggctctgtgtctccacccaaatctcatcttgaattgtaatccccacgtgtcaaaggagaagcctggtgcgaaaggactggatcatgggggcggccttcccccttgctgttcttgtgaaagagttctccgatggtttaaacgcatgggacttcctcctacttgctcgctctcttctgccaccatgtaagatgtgccttgcttcccctttgccttctgccatgattttaagtttcctgaggcctccccagccatgcagaaatgtgagtcaattaaacctcttttctttgtaaattacccagtctcaggtagttctttacagcagtgtgaaaatagactaatacaatcaccttatggtaagtctgtctataaatcacctgaactttcacagactatctagaagaacatgtaaccagagtagttcttgatcatgctatataaattactgatacagaaatagagctagacaggaaggggctggtagtagagaatcatcctctggacatattctcacagcctaatctctagctagcaaattttataatatatataaaaatacaattatttcacaaaattaccatgaaacgattttattgggatattagacattactgaattacttgttctgtgaggtatacagtgaaattaacatgttataaaattgtggtagccggcccccaagatggcctccaatgaatccttcacctcttggtattcatacctttgtgtaggtaggtctgtgtaacccatagaatacagcacagtgacagtaggtcacttccgaggttaggttgtgaaagacactgtggtttctgcctctctctcagatcacgtgctctgggggaaaagccaggtgtcattttgtgaagacactcaagcagcctttagatgactgcaaccacataagaggctccgaactggagccactcagctaaaccactcccagattcctgaccatgtatcatttcatacacaatgtatgaaatgacaaatgtctgttgttttaagctgtttggggaataatttgttacataacaaaatataactaatacaataatacatactgatttaactgaagttgtaacttcataacttatttaggtactaaaaatcacagcaacccgatgcaaagtactaaaaaaaaaatccattaatacctattgagtactgttgagggcatgaggaaagctctttcatactccacataaaacttccttaccgtaatattcatggctgacctctactcttaactcctttctaggataggaggggctaactgatctgacagcaagtttgggagaaaaaattctgaggctcggccaacttcctctcttctttccatttgggatttggctgactgaagagggtcatttgttttggcctgctctcttacacagtaaatgtagtgggacaagctctattcttgttgatagaaaaactcgaattttaaatctgcctagttctttgcagctcgttgttgctccaaatctcagctaccttttgaaacaacttttttcagtaaacttaatttcaatcttcatgtgatttaactggatccaaacacaggcagataaaaaaggtggggcattacttatcaacctctaaactaagtttaattttgtgccctcatggagtttatagtatatttgaggtttaaactaaaacacctggttttaaacagaaactataaaaaacacgattaataggtgaggccgggcgcggcggctcacgcctgtaatcccagcacttggggaggccaaggcgggtggatcacgaggtcaggagatcaagaccatcctggctaacacggtgtgaaaccccgtctctactaaaaatacaaaaaattagcccggcgtagtggtgggagcctgtagtcccagctactcaggacgctgaggcaggagaatggcgtgaacccggaaggcggagcttgcagtgagccattgcgccactgcactccagcctgggtgacagagccagactccgtctcaaaaaaacaaacaaacaaaaaacaaataggtgaaaggccgtgatcattggtaagcgtaagaaaatctgagggagaaaaaaatatagatgcccaggccccatgccaaactcatggaatcatgcatgaaacccaagcagctgcagttttaacaagttcccaatatatagttgacccctgaacaatgcaggtttgaactgcctgggtccacttataaaatggatttgatttttttcaataaaagttacaccgagtgtgcctgcctctcctccctccctccctacatgctcctgctcttaagcctctgccatgaggcttaagacagcaagaacaacccgtcctgtttatttcaatagttttggggggtgcaggtggtttttggttacatggataagttctttagtggtgatttctgagattttagtgcaactgtcacctgagcagtgtacactgtatccaacatgtagtcttttaacccccatccaaccttcttccccaacccgaatccccaaagtccactgtatgattcttatgcctctgtgtttttatagcttagctcccacttttaagtgagaacataccatttttggtttcccattcctgagctacttcacttagaatactggcctccagctccatccaaattgctgcaaaagatattatttcgttcctttgtatggatgaatagtattccacgatgtacataaacattttctttatccactcagctcctcttcagtctactcaatgtgaaggtgacaaggacgaagatctttatgatgatccatttccacttaatgattagtaaatatacttacttttccttatgattttcttagtaactttttttctctaacttactttattgtaagaatacagtatataacacatatgacatacaaaatacgttagtcaacaatatatgctatcagtaaacttccagtcatcagtgggctattagcagctacgttttttgggcagtcaaaagcatggggaaggagagggtggtccctaacccctgtgttgctcaagggtcaattgtaataatacccatttaagaatccatggtatatatggtaagtgcaacaactctagaagagagtgctaggagttggaaaaggaaagagaaaacagaatttaaagcaatctgtaaaggacatgcagggtttagatgaggtggaagggtgagggaaaaccaacatctgctgtgagggcatattaactgccagacattgttctatgtcttacctcatttaagagaatttcatttcacacatggaaaaactgaagcccagagaggttaaataatttgcctgaggccaaaattagttaaataacagaagtgggattagtagatgttttcattttatcagtgaaactgagcctcagggaggttaaatattttgtatgaagtaacaaaactgagattaatatatggccaagtttaaatgagatctgtaaatctaatgcctacactaaaacaaaaaaaaaaaagtgggaagaaaaggtctatattgcttagcaaaacagaggtagggaagcaaaaataaacttacaaaatcagattagaccaccaaaaaacagtccccattttaacttatgtggtgagaaccatatattaaagaccaccagtggcttaaaaatctttttaaaaaatgaatctgttttcattattcattagtttttatctaatgaataatgtatcttaactgatacatttactaaacaattaccagctccaattagcactcagttacaattcaatcattaaactgaccctcaatttagctgtcaacctagtcaaaacagttaagtgattttacggtcatcctcagttgcagaagtataatgtttatggctggagtcattttatttttaactaacattttttaaaaagattgctttgtaacaatgtgttatgagtcctttgtggtaaatactgctttttttttgagacgcagtctcgctttattgcccaggctggagtgcagtggtgcgatcttggatctgaggctcctgcctcagcctcctgagtagctgggactacaggcatgcgccaacgtgcccagctaattttttgtttttttagtagagatggggtttcaccatgctggccaggctggtctcgaactcctgacctcgtgatctgcccacctcggccttccaaagtgctgggattacagctattttaaggactttttaaaaagtgaagctaaacatttattcatccctattcctcatctatagggacttgtgctctatttttctttgaagactgaagtaaaaattcacctttgtgagggtcttcctataattaaaattaatcattttttcctccatagcttctacaaaacattgcctgtacaactctatttagcacttatttcatcccgccttgtatgaaaactatttgtttacaaacgtttctacttctctttaggaataaggactatgcattattcactgttgtattctccctgcatttatggcagtcctttgcacattaaatacaagctttttggctctgtgcatctcttcatctggctgttcatctgtaccctttaaaacatcctttattaaaaaaacagtaaatgtaaaaaaaaaaaaaagccattgatgaaaaagttaatagctttctcaataagaaaagagtatcaattatgcatacgtctgaactaacaaacatgaatgaaataggctatttaatacattctgttttaaaagtaggtttggtcagccatgtaaattgaaaattgggagccaccaagataactcatcaacaaatatgcactatgtactaggcactatatagatgatggtgaaccaaacagatgtaatccttgctcttacagatctcacaacctactatggggccaaaaatatatgtgtatgtgtgtgtgttatacatatatacacacacatacatgtatatatacatatacacatacacatatatacatacgcacacatacacatatatacacacacatacatatgctatgaggaaaacaaacaggtggtgagaaagaattagagtaggggtagaggacagagggctcctcaaatagggtggacagcttgacacaagacactcgagctaagactccaaggatgagaagacagttatgtaaagaaaaggggactagcattgtcagcaggtagctaaggccttaaagcagacagtcatgtgctgcaatgccagcttcaagcgaatacagttactaaagcatatctaaccttctatgtgaatgtagttactaaagcatatcctccaactttccatttttcttttgctattgtttctaccacttctccttttctgttgacaattattttaaatttcctggctaaattaaatgatggcatgaactctggggaaagtaagactacctatgtccaaataatcctaaattccttctagtccttatgactgatcaattcaccctgaagtgacaactatgtcccaattaggaaagagtgtttctttatctgcacttaattttttgatttggaggcttcctgattgctaatcaacatgttgtgtgattacttcaacaagtacttatagaacgttattttgtcactggaaaaacgttctgctgctttctgaactttaggttgctctagagtctaggaagagtgactgtacctaaagcagttcctaattactggacattctcagatctgctagagctacatgtccaattacgagaatatactggaaaaagccctggattagaaatgagaggatgtaggttttagtaccaggtcagccaccttgttaatgcaaatttgagtaaattgttacttcttttaggccttgtttttgctgttttgtttttctgacagtatggtctctgtggtccaggctggagtgcagaggcacaatatcaggtccctgcagtctctacctcccaggatcaagccattttcatgcctcatcctcctgagtagctgggattacaggcatgtgccaccacaccctcgaactcctgacctcaagtgatctgcttgcctcagcctcccaaagtgctgggattagaggtgtgagccactgtgcctagccttacacattgttttcttactggtaaagtgggaatatctagaagttgcatgctacataaattcaaccatatattattggcaaaaaattttaaagaaaaacatcagcttaagagtactaattgagtacatgccttggaatgagcatgagctggaaagaacaaacctgttgttacatcactcattgctgttttcatatgctgctcattgtaaatcttgctcagtggcatgattttagtgtttaaagatttatttgtttgtttgtttaggacaaagtctctacacataatctacttgcttcatatatacatacttatgcatattatgtatgtacatacatgctctcagggctcacatgaaaaaacagccattcaggtgatgtgatttatctcatatgcttactttagagtcaacagggtgttgactccactatacaatactggcatggagaacacataagtcaaagtagacaggacccagccgtaccattggctagggcacaaatatattcacatatgtggagaatgatgtacgtagaaaggtcttcattgcacaatgctctttaataaagatctggaaaaaaaaaacacctaaatgttcaaaaggatagggtagatgaaataatggtacattataaaatggaagattatgcagccataaaaataaggaaataccttaaataataacagaacaacttttaaggtaagtgaacaaataaggtacataatcactatgcatagtatgtaccatttacatagaaaaagggaagaaaaataaaatatatatagtaatttatttgttcttacatgtgtaaaatttttctgaaaaatataccagaaactggtagcactggttgcttcctaggcagaaaatgactgagtatccttttgtaccttttgaattttgaaccacgtgaatgaatgtgttacctatgaacaaaatgacaagtttagatcagcaagacagcagtttgagatgaaatgggattacacccttagtaggaaaaactttttaaagcaggtggtacttctaagagcaaatacctgcacatggaatgttgaaactataaggaactctccttaagagatccatctattccaaacttctcattttatagatctgtaaactgagaccttaaaaattcagtgacttgcataaggtcacacagcagaagagatgggattagatgctagatattccaatatcaagtttagactattaaaaattcagtgacttgtgtaaggtcacacagcagaagagatgggattagatgtcagatattccagtatcaactttagactattatcacaccatcttctcattttctgggggcaaaacagaaccaagtaagtttgggctacattacgagttgtcatgtttttgtttttgtttttttgagatggagtcttgctctgtcgctcaggctggagtgcagtggtgtaatctcagctcattgcaatctctgacccccggggttcaagcaattctccctgccttagcctcccgagtagctgggtttacaggcgcctcccaccgcgcccggttaatttttgtattttttttttttttttttagtagagacggggtttcaccatcttggccaggctggtcttgaactcctgacctcgtgatccacccacctcagcctcccaaagtgctgggattacaggtgtgagccaccacgcccggccgagttgtcatgttttatctaaattttagagtctaatgtataaattaaccttaagccctgaaactactaatttcttgtttggatcactatacggctacacttaaaaatatgctgtgcatacctctatcattgcatgtatacaatatgatagatgcatgatatgacagacacacaatatgatacacgtatttttttctatcctaacacatctgaatttactgaaataactaaaatgtcttaagttacttttttaaatatacacatgcatagcacaagcgtgttgccaaaaatatgaatacaggtttacaattccttaactaaaacccaagggttggatgtgttttagaaataagaatttcatacaatttttaagtgttacagggtatataaaccattatataacacataccaggggccaagggcagcaccccataatcaaacatattaatatagtttcagcaaaacacatgggataaagactatatacagcttctcaatagttcaggtcatattttgctaccaaatgaattttgttgccaagcttaagaagtttttggttttcaccgctttctgaatgttagattgagatgtgggattacagactgtactcatagagtgcttctagaaagcagtcagtcacttcaactctcattttttttttatgagactaaaaaagaaatcatagcaagtagcttttatatcccaggtttgggccaaagacttgtattgtggttaaggaatctaacttagtagaaggtgcacgagctgacatcgtgagtggctaaaatgagagaaaaaaagagaaaatcctaatcatacagaagcactgaactactgcagctgttcgttagttattaatttaataaaagcttcctccctttaaatcatgtgagtttataactggaaataggtcaataaaatttctgtcccacactgctgacaagcgatggacgcaattagctttaatcccactggaaggtactgcactctctctgggaccaggatatgtagaaaaaagcatttcaaatatataggaataaccagaaatgtatacagtattctcaacttgggaccgttactctataatataaacgaaaggggttttctagtcaatctctgctgatctcctgtaccaaagttcttccctttataagtcttgtactaccttttacaagaggaaaaagctctagagcgaaaacacagaacacactaaaatcccttcctttctctttacaactcaagccccgcctccattttgtttctgttactaatttttcttctgaaaaaataccaaatttacactgaaagactaaaattcaactttgcagacaacgttttaaaaaatacaattcagtttggtgatgttgttttgcagtcttacaattttagctacattttaactgaaccaattgttttgttcaatttatgagttaatactcagcaagtttgttttttacaaatagtgtattccattctaaaaatggaagtagcagtggtgaacaagaaaacaaccctctgagttttgtctatttcaggaggaagtactactttctccaattttaatcacaattcataaaaaagaaaaacctaactagctagatcttaaatatacaaatacattaacaatctagtaaagcaacagaaaaaggtaaacaaactaaccagcctatttttgtctggagaaaccccaacaaactgctggattccttggccatttgcattcagaagtaccaaaaactaaaatcctttttactaaataatttcttctacacgagacttgtttcctccacaccaccctatccaaattgtcagcattattccagaatataatcatttagtttgagaccactaaaaaaccccgcagtccaaaataccaattgtggtttttctgtaaagaaatggtcagaaactacaaattgttatcctaggacacagaaccaatcgaccaaaaggacttctggaatatgctgcccccaagatttagaatgcacaggcagaaatagcatacgcggtcacgatgtcccttaagccacatgaccttcctacgaaagcaaaggcttaaacttatcaaatgagaactccccctttctctgaagttaaaacaaggcagggcagctggaattagagcagcagggacagatcggctgttgactagtcagaacgggtcgtggaatgcaaagtccctgcgctttcgctgctccccttaccgtgagaagatctgggagggaggaaaggaggagaaacaccccagaatcctggtagaaaagcccctggcctcgaagatgggctctagggagacagggaggggcagctccgtgtgtgatgaccctttgtgaacatgcactctgtggcagcttcagctccaccgaggctttgggagagcggactacggatgcccggcgcggcccagctgtgaaggccgcgccggcggagagggtccatggcacccccgccggcttcggaagcccttccctctcccacctccgcgggtcaccccaggaaccagcggctcccgaccacgctcgcgcggaccacggaacagcgacgcgcaagcaggtctctttcgtcagcgtaatccctccgcagaaagccgcgcactagttttaatcacgccccaccccctggccgctggcgccacctccgccactcgggcgctttccagcagcttccagaaacgtcgcctccccaaacccagccactcacacatggcgggctcagcagccaccggccccgcccctcctcgtcgccgcagtcgcaactgcgtctgcggccacagggcggacagccacgcctctgcggagggcgaccggaagtgctcacgtcttcaccttccccgccacgccaccgtcctttcaggcccagcgtgcagcaggaaggaggactcttttgccgcggactcaagccggaagccgccttcctagtggagacgcgagtgggggaggagcagtccgaggggaacgtgggttgaacgttgcaactagggtggagatcaagctggaacaggagttccgatcgacccggtaccaagaaggggagtgcccgcggcaggtaagggagaagagggaggggtttctttccgctctcgaaattgggaaaagagacagagctgggatgacctatggggtagtcggcgcgctgaaaggatgggctgggctgggacggggttcaagtgggaaaggttgatgattaaggtatagagttggacttacagatccgtttgggcgcagagaggtgaacgctgaagagaaaccagagtttgttttcgttttccaaggagcgtggagatgggcagggttaacggaccctgcgcctccttcggcttcttagtttgggtgttgaaactcacctcctttggtcctgttcgtctctgattcaagacagttgggtttggtacctgacagggctgggtgcagaaagctgaccctgttcctcggcttccaggtcggttgtggcctcgcttttgacagttcacgtgccgagcctactcgctctcggagggcgagctcaaatgggtgggtttaaggccccctcttcgaacagctgtttccctgggtttctccattttgcacacaggagtgtgaattaagtttaattgaatactttttgcgattcccagggccaccttgacacgttcattgtgctatctaactgggttcatgctgggctaataattcacattaaggcttctggagtataagtggttcacagaagtatgaaaaggggatgttagaagaaagatgctgggggtgaagtagagttgaggaagacagaactggaaagctaggttggtttcacagtacaatgagctttaggtcataatactacctttaggttatattgggctgtttggacggagtttgctgtaatcaggctagagtaaatagagaattttaaactaagcattgacaggctcagacttgtagaggcatcattttgacagtgatatggaagggaaagaggtagagatttgagacctttccaaagaactgtccacagaatttggtgacttactgtgcgaagagggaaataaagaatagggaacaactcaagactttctagtctgtgtgtttggaaggatggagacgcccacatttaagtgagatatgggaaggaggagcagattgtttttgaagggaggaagagcagttacttagggtcaaattaagttgtaaaatcccccccgggattttgtatgtaagtcaaagtgaattgtatttggaagaagaactggggagcccacctctggtattttttttatgtccctcatatggacaaataaacctctggtattaaatgaattttcttttgggggattctatatattcgggatttcaaccaccaacctatctggtttttcccgctgaaatgttgggtgatggaatcaggagagcagatttggagactctttatattttataattgagagagacaaagagaaaaccgtttgatttgaaaaagttttctaggttccctcaggtagatggaaattttcatcaaaaacagtttattcaaggtacatagcctactagtttcccatttgagagtaccgcagaatgatacgacgtgtactgcttctctacgcagaatgaagtataaaattagcaccaaatagtaactttaatttgtcaggtgctaaactttttacatgctttatctcatttaattcttagaagaaactaattttacaagtaagtgtctggaccaacatctgcaggtacaaagcctgaaaagcgtaagtttgactcctacatagttctcttttgtaagtagattataaatagaaccagccaaaggtaataagttgtctgtgcctaaaaagaaagaaaaaagttagcatcagtagttctcaccagaaggggtgattttgcttaccaggggacatttggcaagtcaggaaacttttggctgttggatctagagggtaaaggtcagtgacgctgctaaacatcgtcagtgcatagaacagccttcacaaacaattatttggtcaaagatatttgtagtgctgcagttgagaaatttctgtcttatggttatttcttcaggaataggaaattaagattcgccgatactttctttaaaaagcagttttatttttgaaattattccttggcttgaaaggtttgtgaagtttatatagccgaaccagaatagcgtaattagattttaaagtgaattgtgagccatcgattcccaggagatgggtgtcatagaatcatggattcttggatttgggaaagacttatgcctagaattattttacaacatttctgctaagtggtaattctcctctgccctaaaggtctcctgtatttgattttcctatcattgtgaacccacaattaaaatgctcttaattattttttgcttacactgagctccggtctcttgtaatttttactctgttaaatgtggttctgcaccataggactgcactcaaaacaagcttgccacatatgtaatttgtactaggacagtgtttatatttttgttcagataacaaaataagttaaatgtggtgtaaattagatcatttacaaataataatttgttagcagcttttaataagtagtatttttcccaactggtgaagtattaatgttggtagttgaaaacaataggaatgtatggaatatatggttcactggttcttttgttcctgtcaaatagtggcacaatggatctggggtttttctcagtataatgctggcatatttgtttcaaattgtacatagactctaaaaagttaggctttcaaattctggtcaatatagtttgctttaaatagtagctgcctctactacaagttttatttaatttgttgacaaatgagtctgctatgaaaaccggtcctgttgccagtcactaccctctgttcacaaatttgctgggtttataaatataggtatcattttcacttcaagattataattttagaatatgtttattctaggacatatagccctcaaaatctgcttactatatacgtcttataaaatagcatggttcttttttatagtaaatagaatttttatttaattgtctattgactttttttttccagggttcattgaaaaaatccttagtgatattgacatgtctcaagtgacataaattagccaatgactcggaatgatggattctccgaagattggaaatggtttgccagtgattggaccagggactgatatagggatatcttcactccacatggtggggtatttgggaaaagttagtgaacttattttttgcctgagtgcaaagttttttttttttctctatttttgagacttaaattcaattttgatgttaccagttaacttctaaaaaattgtgtcttccacggaaatcttacagtaatggcgaaagattgttttaatgtgtttacctttctgtgttttattgatacatgaaagtggaaataaaacatagaccttatgatttactgttctttgaaaatatggtacataaattctcccgggtaattgatgttacttttttccttgcaaataaaattgatactattcttaacacataaaatttaatatttaaaactataacataattctttttggaataatagctgtatttaaaggcttatatgcatttcttttgtttgccatgtttaaaataccttgtcaggatacttgtaattgaaaattataattttttctggttacctttccatttaacttttaatattttgatatattctaggaatgtctatattttaatttgctttatttctcttttagaattttgattcagctaaagttccatcagatgagtattgccctgcttgtagagagaagggaaagttaaaagccttaaagacttaccgaattagttttcaagaatctatctttttgtgtgaggatctgcaggtaaagtattaatcttatatagtatatataagatttttcttttttcttttgcttttttattaattgttttaaaagtttactcattttttgttttttagactagatttttaatatgtaatctcagtttgtaagtctgtctggtatacaatgttatttttccacctacctttacttggttgcgtaaagatgttcgtttttattgccatttgatttgcgagaggagaaaatacatttcaaggtttttttctttttttttaaccttttggaggtccttgttagctattagcatatagtagttactctctcatctctttggtttatctttgcaactgatgggaaaagttatgaatttctaatgtacctggaagagtattttggaaattggttagtccaaaaccagtatatatactctgaactaaagagagtatagaatcttgtaaattctaaaagatccttttagaagctctaaatcgcttttagaattatagtaatttgtaccgactggtacggcttttatatagcagctcattaaattctgtaatactccacattttattgtatttgacagtttatgagactgtctcatacacttttaattctcagaactttgcaagatttgtattcctatttcatgaataagaaaataaattgatttcagagggtttgggaacataagatcctgatacagtggcagagctgtggttggaatacagacttctaatttcagatctgtttattccagcaaaaaattagcagttcatcagaattacctggagtgcttttaataaatttctgagtatcacccccagatgctgattcaatagagttggcccagaattctgtggttttgtaacatttgaggatgagtctgatcatcatcagccaggtttggaaaatactagactaaatcacatggttgttaatagatacttatgctgggtataatttgaagtaaagtaatcccaggcgtgtctacaaatataaatttctttatgtttatattcagtaattttttttatgagtgtcactgtttggcactgttgcagatacaatgttaggatacaataataaaacaaaaatttcttgcccttaaggaagttatgtcatagagtgggaaagacagtgaacaagtatgtgtttttctgtcaggtgataaaaagtgctgtggagaaaaataaggcagtagggactggaatgccaaagtagggggagtttgcaattttaaataggatggtgaggggaacgcttcaatgaaaagtgcaattcgagcaaaagcctgaaagaggtgaagagcagtgagctttctaggcaggggaagcaagttccaggaaggccctgagagaatggaggctgcctgtcatgtttgtgctactgcaatgaaagcagcagagcgatagaaggtggatcagaaaaataatgggggagctggaccaagtagggtcttataagccattgtaagctttctggcttttactatgggtgaaaccaggaaccatggcagagatgttggcagaggagtgacataagttgacttcagtgttaaaagcattactgtggctgcactgttgaaaatatatgtaatgggcaagacctgaagcagggagattagttatagtataatatgaattatatttggtccttgtctatggtttccgttacagagctaaaagtcttggaatttcctgaatgataagagtgtcctgttattcagaatgagcctgtttgctaacaccggggttcatactattgtggtgacttaggatggagccgtagatagcctcagatggggcaagtagctggaaagaccacatgattagagaattaacgggttagaacttttagccccacgtacaggcctccaggaaaggagtggaggggctggagatcaagctgtataaaaatatcaagatttggatttaatgagtgggttgctgggggctggtgccgtgtaggaggtggtatgcttagaggaagtggaagcttcatacctcttctgtcccataccttgccctactcatttcttcatctataccctttataatatcctttaggataaaccaataaacataagtaagtgtttgtttgagttctgcgagctgtccttgcaaactagttatgcccaagaagggggagtgggaacctttgtagccagtcagtcagatgtactggtggcctggatgtgggattggcatctgaagtggagggagtcatgggactgagccctcaacctgtaggatctgacatggtctctaggtagataacatccaaatggaattggattataggatacccatttggtgtcctctggagaattgcttggtgtggggaaaaagcccccacacatctggtcacaaaagtgtgctgggaggatagaatatgtgaaaattgtcataatcaaaatggagtcacttgtgttaaaaaagaaaaaaaaatcctgactggccaggcacagtggctgacaactgtaatcccaacactttgggaggctgaggcaggaggattgcttgatcccaggaattggagaccagcccatgcaacatagtgtggccttgtctctacaaaaaaaaaaatttaaattagctgggcatggtggtgtgagtctgtagccccagctacccgggagggggactacgggtgcacggcaccatgcccaggaggtccaggctgcagtgagctgtgattgtgccactgcattccagtcaggatgacagagtgtgagaccctgtctctattaaaagaaaaaaaaaagacaaatagatccaggaaaggctatgaagagagagctttcatgcataaataccaaaatatctcaaaagactctgcaaaaaccacacccttgcacaaaggccatcatgaaatacttctgaaatacacagaaaatacatcatgaaataaatacacagaaaatacttctgcaaggacatctgcccagcaactgcctggtccatctgtggacgggtgtcatccttgttattgatccttgtagccaagggtaattatctcaaaacaagtatgtgatcctccttattttcctttaaaaaccttttgtcttcccttacctccctgaacacacacagtttactatggcatgtgtattcccattggaatactttattcctgaataaatgtcactttctttttagaagcttctcttttctttttatttagattgataagtagaaaggaaaaaaagcttttttccctttggactagttgaaggcagttgcagtattctgggggagagggtggtggcagaggtgttgaggcatggttggagtttatttatactttgaaggtaaagccaacaggatttgctgaaagattgggatatggggttggaaagaggaatcaaggatagttccaagatttttggcttgaaaaattagaagaatggaatcgtgaattactgagctgggaagacttggaagagcaaggttttggggagaagatcaggactgtaagaatagagaagtccttgtccccaggagttaggtttttggctattaaagttagatgtactacatagatttttagttggttttttgttttttgttttttttttttttttttttgagacggagtctcgctctgtcacgaggctggagtgcagtggtgcgatctcggctcaccgcaacctccgactccctggttcaagggattctcctgcctcagcctcctcagtaggtgagattacaggcatgtgccacccagcccagctaatttttgtatttttagtagagacggggtttcactatggccaggatgggcttgatttcctgacctcaggtgatccacccacctcggcctcccaaaatgctggggttacaggtgtgagccaccacgcccagcccggagttttggtttttgaagcattctttttcaagtgataaagcaaaaaatatataatcaagaattttaagtatatactttggaaatgttaaaaaggaacatgagtaatttattattatttttttaatttctagtcagcaatgagagcccagtgtactttatgaagtagattggtttacaccaggagtgagcagacattttgtatgatgcacaaacaaggaatgatttttttgttttttaaatggttaggaaaatatcaaaataaaaaatgccagaaaaaatcaaaagaagggccaggtgcagtgtttcacacctgtaatcccagcactttgggaggccaaggtgggtggattctcttgaggtcaggagttcgagaccagcctggccaacatggtgaaaacctgtctctactaaaaatacaaaatagccgggtgtggtggcatatgcctgtaatcccagctacttgggaggctgaggcaggagagtcgcttgaagccagtggcagaagttgcagtgagccaagatttgagccactgcactccagcctgggcgacagaggagactctatctcaaaataaataaataaataaataaataaataaataaatcaaaagaagaataccctttcataatatgtgaaaattaaatgaaattcaaatttcagtgttcataaataaagttttaccggaacatagccatgctcaatcatttatgtattgttcatggcttcttttgcatacaacaacagagttgggtagttgtgacagactatgtagctcataaaatctaaatatttattatctagccctttatcagtaaactttgctgatccctgtataagtcctctgaatcaaattatttccaaagagttccgttataaaatttggagtttactctgctgtaaattgcaaagaaccatttggaaaacctcttttagtcaggtatttacattaaaatgttccttgatttgtaaacactaatattcaagactggtccaaaattataccaaattgaaactctcaagtgtttttaaacagtaggaagttttaactttttttttttcgtggagtagtctatcattcagcgtttactttggaacatttaattagtcttttttaaaaacccatgaaatttataataaaaattttaaatcattaatgttgagtaatcaaagaaaactttttttgttttctccatttgtaaaatgagtacattattattataatttgtctttggccataccttgttgataattacttatacaagtataagaagacatggtatgttttcctttttcctatttcacaagaataagtacaggaatttacttaagctgctccaaaactcagtgaaagagacaggattaggtttttttcagcattggattttaaatgatactagatggttgcgctgggctaaaatactaatgctttgtgtatatttttatgacttttttgaagacagcttaaaagctttattctagttataaaaatgatacatgttcactgtaaatagaaacaagtcaggtatacagagatacaaatatttagaacatgtggaaagaggcaacaaaattttataaaaagaaaaaagataaaaatctgaaatcattaatttataagggaaaaatcagggcaaggacaaattatattacagattggcctatggtgggagcacagattatatagagaaaagtcagtgaagacacttgcgaagagtgtgggtggaaatcactaagttttgcagtcccggggcctcttatggtttattactgttttgttctttttttttttttaatatgcattcctttggaaccaagggtttattatgttttgaataaagtagaggtgtaagtaggatgcatataccatgatcttgactacttgagattcacaaagggttttcgtctcaggatttttttttctcttaaaaaaatttgtattaatttttaaattgtaaaaaaattcatcaacttaaccatttttatgtatagagttcaggagtattaggtatattcacttgtgcagcagatctctagaacttttttcatcttgcaaaactgaaactctgtacccattaaacaaccacttcccattttcctctcccccagcttctggcaaccattctagtttctgtttcttttctttttttttcttttgagatggagtctctgtcgcccaggctggagtgtagtggcatgatctcggctcgctgcaacttctgcctgcgggttcaagcagttctcctccctcagcctcctgagtagctgggactacaggggtgcaccaccatgcctggctaatttttttttttttttttttttttgtatttttagtagagacgggggtttcaccatgttggccaggctggtctcgaactcctgacctcaggtgttctgcctgcctcagcctcccaaagtgctgggattacaggcttgagccactgtacccggcctctagtttatgtttctatgaatcagactcagtacctcatataaacggaatcatacagtatttgccttttttgtgactggcttatttcacttggcataatggcctcaagattcatccatgttgtagcatggatgaatatacagttaggagttccttttcttttttaagtcttaatctccagtttatttctgtttatttatttattttattatactttaagttctgggatacatgtgcagaacgtgcaggcttgttacataggtatacacgtgccatggtggtttgttgcacctgtcagcctgtcatctacgttaggtatttctcctaatgctatccctcccctagccccctacccgccgacaggccccggtgtgtgatgttcccctctctgtgtccgtgtgttctcattgttcagctcccacttacgagtgagaacatgcggtgtttggttttctgttcctgtgttagtttgctgagaatgatggtttccagcttcatccatgtctctgcaaaggacatgaggagtttcttacttttaaggttgagtaatattccacattatgtgtatgccacattttctttatccattcacctatctgcagatgtttgagttgctttcactttttgggaattgtgaataatgctgcagtgaatgtgggtgtgcaggtaccttttcaagattctgcttttgagttttttttggatacgtacctttttatgatgctttaaatacatatatgctatttttaaaggattctcagttttctgacatatgataggacttaggaagtaatctcaaagcatcatgttgacaggttgttagttgatggtgactgcagctagttggaaagtcagaagaatctagaacttgtccatttatactaaagaatttcatagtaagtgcagtattatgagtgtaatgttcaattggtagaagaggctatctgaggggatttagtgcatttcagttatctgttggtgtgaaacgaatcaccttgaaacttagtcgctcaaaaattttaatggtggctgggcatggtggctcacatctggaactccagcactttgggaggccgaggcaggcagattgcttgaacccaggagtttgagagcagcctgggcaacgtggtgaaaccttgtctctacagaaaataccgtggcaggcgcctttagcaccagctacttgggaggctaaggttgtaggatctcttgatcccaggaggcagaggttgcagtgagctgggatcgtgccactatactccagcctggataacagagccagaccctgtctcaaaaaaaaattttaatggctccatttattatttcacatgattatgtgagttgactagggaattcttacacatcacaccatgtcagctgggacagctgaaatgtccacatggctggcagttggtactagctgctagctggaagttgagttcaaatagtcagccaggggtctcagttattttccatgaggttctctccatgaggccagctgggctcttcacagtgtgatagctgggactaagaaggagtgttccagaagaagggcttgtcctcttgagccagtgcttatcaggcctctatgtatatcatgtgtgctaatgttccatcaaagctagtcacagggccaagccaactctgtacagtgtagggactggctgcaggagggcatgaattaccaggaggtgtagttctctagttcatagggagggccatcaagatagtagtctaccatacttgtgtaaaagaaggcattaattaactattattattattattattattattttagagacagggtcttgctctgttgcccaggctggagcagtagagtggggcaatcatagctcattgcagcctccaactcctgggcttaagcaatcctcccatctcagcctcccaagtagctgggaatacgggagtgtactgccatgcccacctgaaaaagaaggcatattttaaaagcagacctttagtgtagagggttcttgaatttgttatttaaaatattctggtagtttttaaacttaggaaagacccactgattcttttagtgatatgtttacattgttgttatttggcataaattgtgttaatgcacagtaagatttcatgaagtcattaaaattcagccacttggactctaaacccaataaagatgtaaaacagcagtgctatgagatgcatattcagtttcaaaatataggaaacacagaaattactctgtgcacttttaatttgaaaatacttttaaaatgtgtagtataatgtagtgtctgtcccaaaagagtaacattcattatagtgtttctttacgttgttgaaaattttaaattcacttaacattagatttttattaaagcaaaaatatgttttccttattagcttacccttttgtaactcagattaaacccttgattgttcaaattaacctgaaaaaaattattcttttggaggccaaacttttgattaagtagttgtttgtctctaattttttcaaatttatgtgtataaatataacctgtcatcaaatcaatgctaacattctatacatgtttttcatgatatgaaaactataaaacatgaagttatttgaatttgtgtagtttttatcattttatttttactttccagtgcatctatcctttgggctctaaatcacttaataacctaatttctcctgatttggaagaatgtcacactccacataagcctcagaaaaggaagagcttagaaagcagctataaggattcacttcttttagcaaattccaaaaagactagaaattatattgctattgacggtggaaaagttttgaacagcaaacataatggagaagtatatgacgaaacctcgtcaaacttacctgatagtagtggtcaacagaatccaattaggacagctgattccttggagcggaatgagattttggaagctgatactgttgacatggctactacaaaagatcctgctacagttgatgtctctggaactggcagaccttcccctcaaaatgaaggatgtacatctaaactggaaatgccactggagagcaaatgtacatcatttccccaggctttatgtgtccagtggaaaaatgcttatgctctctgttggttagactgtatcctgtcagctttggtgcactcggaagagttaaagaacaccgtgactggactgtgctcgaaggaggaatctatattctggcggttgcttacaaaatataatcaagcaaatacacttctatataccagtcaattgagtggtgttaaaggttggtactaatattttatttttatttacttatttattcatctggagtcagggtctcattctgtcacccaggctggagtgcagtggcatgatcatgtctccttgcagccttgacttccctggctcaggtgggcctcccacctcagtctcccaagtagctggaactacagtcgtgcaccaccatagccagctaagatagtgagatggtggccccactgtcttgcccaggctggactcgatttcctgggtgcaagcacccttcccgcctcagcctcccaaagtgctgggattacaggcatgagtcaccattccagcctacttgtctttaattcttaaaaatattaatgttgagttttgtctcccagcatgtgggaaagatgtcatccattgcttctgtttcctggaggcctgggagcaaggagcccaggaacagtatcacgaagcttgagataataccagttacattatcctgactgcccaaaaggcagtttttttgttttttttttttatactttaagttctggggtacatgtgcagaacgtgcagttttgttacataggtatacgtgtgccatggtggtttgttgcacccatcaacccgtcacctatattaggtatttctcctaatgctgtccttccccaacccctccattccccatcaggccccagtgtgtgatgttcccctccctgtgtccatgtgttctcattgttcaactgtcacttatgagtgagaatatatggtgtttggttttttgttcttgtgttagtttgctgagaatgatggtttccagctttatccatgtccctgcaaaggacatgaactcatccttttttatggctgcatagtattctatggtgtatatgtgccacattttctttatccagtctatcattgatgggcatttgggttggttccaagtctttgctattgtgatttttttttttttttttttttttttaagacagagcctcactctgttgcccaggctggagtgcgatggcatgatctcagctcactgcaacctccgcctctcaggttcaagcaattcttctgcctcagcctcccaagtagctgggactacaggcgcccaccaccaggcccagctaatttttgtatttttagtagagacagggtttcaccatgttggtcaggctggtcttgaactccagacctcatgatctgcctgccttggcctcccaaagtgctgaaattacaggtgtgagccaccatacctggcctaggcagtctttttcaaaactctaagactgtgcttgtgtctcagggtgtcaggataatagtggttagttttaagtgtttaaactactgaaaagcagaatgaagaagtgagtaaaaatcacccataatcacacaacctcctaagatctcttggcacaataagggatatgtttttcattttattctctgtaaaataggatacttatgaacccacctcccaacacaggaagaattaaaacattcccaataacttacatttacctatgcgtttcctcccatcccattctctacctcccccccataagtaatcattatctgaaatgtgtttcatcattccatcttttcttagtttttcttacatgtgtttatctaaacagtatacagtagtctccccttattgtagttgtacttttcttggtttcatttaacccgaggtctgaaagtagatgagtatagtacagtaatatattttgagagagagggagaccacattcacataactttcattacagcatattgttataattgttgtattttattattagttttaatcttactatgcctaattataaaacttgatcataggtatgtagttataggaaaaagcataatatataaaatgtttagttactatccaaggttttaggcatccactggggtcttggaaggtatccctctcagataatgggggatggatggtactgaaccctgtatatacaatgtttttccctatacatacataattatgatcaagtttaattaagagtaaattaaatgtgggccaggtgcagtggctcacatctgtaatcccagcactttaggaagctgaagcgggcagatctcatgaggtcaagagttcgagaccagcctggccaacatggtgaaaccccatctctactaaaaaatacaaaaattggctggctatggtggcacacgcctgtagtcacagctactctgggaggttgaggcaggagaattgcttgaacccaggaggtggaagttgaacaatcacttgaacctgggatcacgccactgcactccaacctgcctgggtgatagaatgagactctgtctcaaaaaaaaaaaaaaaaaaaaaaaagtaaagtaaatgtggctcaacatgttgctgtcagttggaacatttgtttctgatcgtgtcttccacccacaaattgaatgctttttccatcttaacacttatcaggcactgtggccataacttgagcagttgagatgcaacagcaaaattagcacaaatttctttttctttcttcgcagtttcatggataagagatttgttcttagatctcagcaacctcagcatatgatttttttctttaagttgagaactttgacctttttacttagagaagcattttacagcttctctttggcatatctgaattgccagcattactatgctcgtgctttggggccattattaagtcaaataagggttgcttgaacacaagcactgcaataccatggcaatagatcgcatcaccaagatggctgctaagtgaaccacaggcaggagtgtagacagcatggacacattagacgaagggaagattcacgttgccagtggaacacagcaggacagcaagagagttcatgatgctactcagaatggcatgaaatttaaagcttataaattgtttctggaattttccgcttaatattttcagaccacggttgagttcaggtaactgaaaccataggaagcaaaacacggatgaagagggaccacttcgtattgcctaatttagtttgttttgatcttctgggacctttttttcttgttgtaaaaatttatggggctgtttatagttgtggctcattgatttttcattgctacataatacttccattttgtaaatataacagaatattcatctacctgtcagtggacagtggggtttttttgccattataaatgctgctgctgtgaccatttggggggcaagtctcctggggcacagtatgagtttcccttctgtataacaaaggaatggaaaattatagactttcgtgtccaaatttacaagataatgacaattgttttccaaagtggttgtaccaagcaattctcccattaatagtgtatataagaggtcttcctgatccatatattcttcttggtttattttcacacttttgagatttttgctatttgagtggtataaaatggtctgtgatcttgatttgccgtttccacattttgaagaggttgtcggctctatgtgtatatattgctcatatttgttccctcttctgtgaaatgccttttgtatcttatccctatttgttctgttctgttgattgtcacgttttaattgatttgtatgagtttgttccttgtatcattgttgctagagttacatcagatgtgttgctgaatctgctcccagtttgcagcttgtgtttttactttttaaaaactgtcttgatttatagggaagtctttatcttttcatttggagctagtaatgtttgtggctttttaaagaaattattactattcccaaggtcagaaaatcattcacctatattttaactgaaaagttataaagttttgcttttgacattgaaatttctcattcagttggaattcatattgatgtgtggtatgaggtaaggatccatttttttcccatttgcatagccagtttttgtagctccactttattttctcacttgatctgccatgccacctctagcatgtatcaacatatcatgtatgtgtgcagctgttccttaactctcaattttattctcttggttactttgtctaacccagcactcatactttttaaattattatggctaccttgtagggcaagaatcctcacttttattcaacttcttttgaagtgtcttgatgcatattttttctgatcttacttggccatatatattttggggacagatgtgacatcataccaagctttctttgcttgacattgtagatattttcttattcattaatgtgctaaaaattttgagtttggtcatacagtcttttatatggatcttatacatcgtttccctcttgttaaccattcaggctgttactagtttttgctgttgtgaattaacaccaggacaaatatccatatatcttttgaattaattactgactagtttcctaggaaagatattagaatatgaatattaaaggtcttgctgaatacagttttcagaatggttgtaccaatatataattccattttcattatgtagaaaaaatacctcagtgttttctaaccacctttggttagaacattcaagacgttatggttttgttaggtaagaaatattttgtttcagtgtaggttttctttgagactgaacttttttgtgtgtgtcagtcatttacagttttttgcaatttttaaaattcagtttctcacaagcattttgcctttgacttttcttctatttctgctttctctaattacagaaaccccagtgttaagtaggtgacagttcagttgtttgctgcagaagagcagcagttcaatattggaattaactttaattttatgtttttaatctgttactaattttttacagaataattgtagtttttataatctggttaattatatgtttgagctgcattactttgcaatgtaagtttttttttttggcatggtcaaataacaaaaattctggttaatgcttatttcatattacaggagaatccagatatttcattagggaaacatataagcagagtgtgatcaggctgtatgaattatttataagagatgtgagtgaaaagatctatttgtagcttaagagtaagtagagtcagatgcatgtagagtcttttattcaaaataattttcttattaatcttggatagtttcttgtcacagtaattccattttgaagataataaatattaccataaagaagtgatcaaaaacatagatatgtgtgcccaaaggtatttatcacaatagtatttataatagtgaaaaaagaaacaactaaaatgtctggcaataggagaatgattaataaagcgatgtttcagctgaatatagtggcatgcgcctgtaagcccagctactcaggaggttgaggctgcaagatggcttgagcccaggagttaatgaccagcccaggcaacatagcaagaccctgtctccaaacacacaaacacacacacaagtgctatgtttcagtcactgtataataactagccagattttttgttgttgttgttttgtttttgtttttgttttttgagagagcatctcacttgcccaggctggagtgcagtagtacaatcacagctcactgcagcttgtagaaccctaaccctcctgggctcaaatgatcctcccacctcagcctcctgagtagctgggactacgggtgggtaccaccatacccagctttttttctaagagataggggtttcactatgttgcccaggctggtcagtttttaatgaagcacatttgtgtagacaaagcaggatgtggaaccggataaacactatgttgccactgaagaccccttcaaacccctcaaaaatgacatagaagggaaatatgagatattagtttgggaaataattgtaactttattaagactccttataaatttatctgttcctatgacctggctaagttcaataaaagttacacagagtggaataaatggttagacatcatttgtagtataagtaattgcacataaggaggtaactttagctgttttagagatagacatagtatctgaaaggttagttattttactagacctgtgattatttgggtgagaaaggctttcactgagattttacccattcagtaagtactaatgatattgtgctgatagcatatattaagggaatatatggtataccacagagaaagaattaaggaaattttgtgttttgctttttgtctgtttgcaaaacttactgactcagctttcattcttgggaatgtgtcagttttctgtgggaagatatacattgatgaggaattgataatgttctctgtattttcttagatggagattgtaaaaaacttacctcagaaatatttgcagagatagagacctgtctgaatgaagttagagatgaaatttttattagccttcagccccagcttagatgcacattaggtaagtaattggtaaaacttacttgtattatactcatctaccatatagaaatatgtacctcataaggaaatataatactgtttgattaccttggatgatcatattcttgggagagagaatctgagtagtttgacttaggaatctaccactgggtaagttattgtagggcagagctgttccatataaatatgtaggctggtgttccacctcttgagagtgggtgcagttctcagaaccaggagaattttagggggcatatcattagttgcttctctagtacgtttcctagtagacagatctagcatttttaacctcaattgtgcattaaaaagcaccgagggaatttaaaagtaaatgccaatgctggggcatttgaattaggatctcagggatggggctcaggaaatcagtaatttttagaaaccccacatgattgttatatgtacccagggtttagaatctcatctaaaccaaccatagtaattctacttccctaccagtgattggtttaggaatgtccttgtggtagagttttggccagtggatattaagagaaatatgctgatggccttttgggaaagcttcctcgcctttagaaagggcacaaggatgggacctctttgttctctgtgacttggtttttggcctgtgggagtggcgtgcagcaagtgagctagagagtctgtccaaacctttctaaatttttttagtattgcgaaaaggagctgcggggtttttttgtttgtttttgttttgaaagggctttttgttttatttttcttgtatccttgtattaactcttctattaatgttatagtagcagaatatgatactccctattagtaataacccatattatgtaaaatatcagtgccttctagtttttctctcaatgagtgacatttaacttatattaaaaaatgatatttatattttataataaaatcagttgttgctactgatttgtctagcatgtacaaaagacaccatgcttccagatcattataaaatatgatattttataatatatttacaatatatttataacatatttatatacttagaatatattttataaggctgggcttggtggctcatgcttgtaatcccagcactttgggaggccaaggcaggcgtatcacaaggtcaagagattgagaccatcctggccaacatggtgaaaccctgtctctactaaaaatacaaaaattagccgggcgtggtagtgtgtgcctgtagttccagctactcgggaggctgaggcaggagaatcgcttgaacttgggagacagaggttgcagtgagctgagatcacgccattgcattccagcctggggacagagcgagactccgtctcaaaaaatgtatatatatatatatatatatatgtgtgtatgtgtgtgtatgtgcgtgtgtatatatatatatcgggaagcatggcatcttttgtacatgctggacagcttttgacgtacttctttgactcatgcttctgccccctaattttcactttttttcctacattttattaaaattaatatataatagttgtatatctgctttatttttcatggacttatacatacatatttattctgttcttataaaagtctgatttttcgtatgccaaatttctgacatttcctcctctaggcctgaagaactgttgtaatttatgcatcagataggccctcagatggaatgaatattcttttttctttatatcaaggtgtaatttacatatagtaagaccgtttttaagtgtgtacagctctgtaaccctcactacaatcaagatataggactctgtcactctaaaacttctcaccaggttcatcacccccagccactgatctgttgagcgaatactcatttcaaaggagctttttccgtaagatccctagagtttagatggaagggctttcgtggtgcatttagcagataccatttcccttctagactccctacttcagttcccagttgaattaaagaatggtttctcccccagcctgagtcactacccttcttatccctgataattatttttggaacaaagttacatcttttgctccacctccgccatgggcctggttttctatgtaacagaaggaatttttaaattattgttttgtgtaatcataataattgggcaagcatacagctcttttcagtgcaggaggattcctctcttgttttactgcccattcaaggataggtgctatattttagctgaagatcttactaatgaaatgctctgtaatcatataacttatttaaagatgtgttttgagctctttcataatattttaattcatggagaactttatgtattttagacctgaagattttatattgtcattatgaaatgtaaattgtttgctttttcagttaatatatagttacaatagaatacggatttaaaggctgataatgaattacaaaattgtgctatatgacatactgtttatgcatacagtgttgcatattttcatttctaggatattgatttgtatttctacttacaaaaaaactttttaaaacttattttatggctgggcccggtggctcacacctgtaatcccagcactttgggaggccgaggcgggtggatcacctgaggtcaggagttcaagatcagcctggccaacatggtgaaaccctgtctctactaaaaatacaaaaaattagccggacgtggtgtaggtgcctgtaatcccagctactcgggaggctgaggcaggaaaattgcttgaaaccaggaggcagtggttgcagcgagcagagattgcgccattgcactccaacctgagcaacaagtgcgaaactccttctcaaaaagaaacaaaaaaactttttttaatgtttttgttcaaaagtagcagtgagactatcccgcaaaggtgactactaaaatagcctttgtaactactgatatttatagaatatgcttagggttagggtataactcgcttgtattatactcatctaccatgtagaaatatgtacatcataaggaaatataatactgtttgattaccttggatgatcatattcttgggagagagaatctgagtagtttgacttaggaatctaccactgggtaagttattgtagggcagagctgttccatataaatatgtaggctggtgttccacctcttgagagtgggtgcagttctcagaaccgggagaatatttaggggacatattgttagttgcttctctagtacttttcccagtagacagatctagcatttttaacctcaattgtgcattaaaaagcaccgagggaatttaaaagtaaataccaatcatagggacatttgaattaggatctcagggaaggggctcaggaaatcagtaatttttagaaaccccacatgattgttattgcttaggtaataacacctactgtctaccttgtggtcctgccaaggtgactgttcctggccatgttccaggcaactgtagttccaggctagggggagaactggaccatggaagtgaggctctgtccagggtaggggaagggatggaaggtgactgttcctggccatgttccaggcaactgtagttccaggctagggggagaactggaccatggaagtgaggctctgtgcagggtaggggaagggatggaaggactcagtctcttgggccaaatcggtaaggcagcatctaagctcctctgagaataggaaggagagcaaccaattggaaaaagaatgggaaacatgtagattctcctgcttaccttactttccagtctcaaagctggaagccagcattcactgttcagttattttcaatgacaacaagattcaaatcttcagttgtaaagttgttaaaggaaaggattagactgaaaagttaagaagaacggtagatgaagagtccaaagagttgaggctggtcatttaaccattgtgtggccacgccctctccacaggtggaacaagatgatcagaatagaaatggccaattctgatgtgtttctacagtgtttcactgattacattttttaacatctgtagcaaaccatttccataatttttttttttttttttagagacgaggtctcgctctgtcacccaggctggtatgcagcggcatgatcatagctcactgcagcctcaaattcctgggctcaaatgagcctcctgccttagcctcctaagtagcttggactacaggtgtgtagcaccactctcagctaatttatttcattttattttttgtagagataatgcctcgctatattggccaggatggtctcaaacgttcatagaaactggttttaggttcctagaggctggcagcaattctcagaggtaacgcaagcagtcttcctgccttggcctcccagtgtgctgggattacaaggtgtgagccaccacacctcatcaatttttgttttaatatactctaaggcttatcatagttccgagatctttttttttttcctgagaaatctagaaagatggaagacagtatgggtcttttgtggattttttgtcctaagaaattttcataaatgtctgccaaggaaaaggaaagagatcaaagtggtaattaaatctttaggatggacatttttagaaaaatgctttataaacttcccctctcccaactctgagtgacttattgtgtcatactgtattaacacatattcatgctgtaaatatagtaagaaaagacaatagttcacaattttggtttagtttttgccattattgattatgagcagtaattcttccttttctttttgaaggtgatatggaaagccctgtgtttgcatttcccctgctcttaaaactagaaacccacattgaaaagctcttcctatattctttttcttgggactttgaatgttcgcagtgtggacaccaatatcaaaacaggttagtttcttttgttttttaaaatgggttcttctagtttctccaccactaaggttaagagaacaatttgagcaccagacactacagtttgcttgcttctttaaactggaagggtcaaaacctcatcgtttgatagactgctagtaggatatttcctaaggagttcttcagtgggaaatagggacgatgagaggaataatacacctcccttctccagagtccttgctgagtagaatacctctcagaatgccatgaaactgtaggcatttttgtttattcctctattagaaatgaggggttttgcttgtttactttaggtttctaacattatagacactagttttaggctcttggaggctagcagcaattctcagaggtaatgcaagcttccccatttcttcccgtagtcctgtgaaagaccagccacctccagaagcctacacatgagtcttctcagccatactttctgcttttcctaatgcctctcagcagcgtattagaaaggccatgatcgatgtacctgttaccttcaggctttgcataaggtgtatatgaaacataatgaatttcgtgtttaggctcaggtcccatccccaggttacctctttatcttggagacacttctggtcccatacatttcagataagagatattcaacctgtacccaccacgtaaggagaggaataggttttagaagaggagtcagggaggcaaggtattcccagagggatattctcacttggtccatacctgagaaagttgctggctggcagttaggaagatgaccagactggctcaattgttcgtgtattcaaattattacaatagaaataactctttccacccccccccgccctttttttttttttgagttggagtctcgctcccgtcacacaggctggagtgcagcagcgtgatcccggctcactgcagcctccacctcctgggttaaagcgattctccttcctcagcttcctgagtagctgggattacaggtgtgtgccaccacgcccggctgatttttgtatttttagtagagacagggttttgccatgttggccaggctggtcttgaactcctgacctcaggtgatccagccacctgagcctcccacagtgctgggattacaggtgtgagccaccatgcctagccacacttttctttagcttaagtgcttaagttagaaaacttgaagtctctctaagttactcaagtaaaatgtgagataaaaatattacttttgaaggccgggcacagtggctcacatctgtaatcccagcactttggtaggccgaggcgggtggatcacgaggtcaggagtttgagaccagcctggccaacatggtgaaacgctgtctctactgaaaatacaaaaattagccgggcatgatggcggacacctgtagtcccagctactcgggaggctgaggcaggagaataacttgaaacccgaaggtggaggttgcagtgagctgagattgcaccactgcactccagcctggtcaacaagaatgacactccgtctcaaaaaaaattaaaaaaaattacttagatattcattatctaaatatgaaatcctttttaggtatttaaggagtagtcaaggagagttcagtctgggaggatgctccagggaatgcaggcaacaaaggttttgttttttttttaactggttaactcagatctactagaacagggtaagggaggccacagagtagacaccatgagcaaagctaaccctcctgagttgaaaaaattatggacgagaagttatcattgaaattaactgttggcagacatatccaaagaatatcgcaaggatttggtccctttatgcatcctgagacagatgaatgtgtggaatggcagctggtgggcaacagagcgatattggcatggtggtgatacagggaaatagtttcatcgtgttaaaagccatggaacaaagatacataatggctgctctgcagaaaaatccacgtcccctctccaaagggcctgttttactctgatgtaaaaattgggtcagataaattttcatattaagctttttgttgagtaaacttttgtaatagtccccaaaactcccactagaacagggtgagaattaacgttttattcatacctaggacttaaataatttagtgtaagcaagtgagtatgagaacacatctgtttccagtcttctatcattgctttatataaattctctggttttctcctcacagtaactcagtgaggaagatcctagtgtcctcatttggcacgtatggatatgacagcttgaaaggggttagattgattcccaagatgacacactgtaagtggcagagtcaggagacacacttaggctcttctggcctctaagactttcttgctcactgtggtatactccttaatcactacctgggttttaaataatataaataaccttgctgattaaaatcagcttaattgtagcttctctggaatccatatcttagttgtttgacagttttcggttgagtgtcttctgtgtgttaggaactcaggcactggaaatagtgtatctttgccaaatttactaattaggtagagagataatacacgaacacataatagaggtccagtgacttcgtaattaatctgatctttgggctgcttaacgttagctttgaatgcaagatgttaaatgcgttttagagatatatagcacaaactgtgagagctcaagggagggaagccactagccgcttttgtttgcttttttgttttttaaaaataatcttactttgttctaaaaataaaagtagttatagagggaaagctaaaatgaagtgacgttttcttaaatatgttttaatatgtcataacttaaaacttatttccacttaatctgaaggagaactgtccagcaaattcctttgtttttgtgaagctgtttttagtgccagcataagggctttttactcaacttggaaagtgtaacccagagtcagttaaaaacatagtcttcagaggcagatctcaggtctgttatttatcactgtactctatgtgtcactttccccatctgtaaaatggggataagaatagcacctgcctctgagagttgtttggaagatgagtgtccagtgccatgccctttgcacatagtttaagtgttcagaaatgtcagatgtcatgtggagaattaacacttacttgctgagacagtctcctttttataaactaaacagtaggagcctttacataacaattatctttgaaaatttaagaatttagcagaaatcagtgcatttgttgatatctttatgttgctttgcttttaaaatgttaacctccctgactactgatgtttttaacagacagtgcttcctcacaagatttataagtatttgctattgtttagaaaggaagcttgtatctcttaagtagctgctctttaaattacaaatatttttattaaagtggatgcagttgaggtttagtgtacatctttaaaggtcatctttttagatggcgttgctctcaagtattcagactaaagtgcaaatttagaacttgtgtaacctgtgaaaacaaaatttgttcacaattaatgctgtgtgtgtgtgtgttttttttttaaggattaaaaaaagttaagttgtatgtattcctgattttatgtttggaaacatccccttttcatttttggttgtctgtaatggctagccagtttgagttatttgagtaaggggtgagctcttaataaatttgacaaccttagaacagtggttcttcactaagggctattttttcccccttgggacatttggcaacatctacagacaactggatgccgttactggcatctggtgaggagaggccagggatgatgcttaacatcctacagtgcacaggacagtgcttcacagcaaagactctctggtgaaaaatgcagtgataccattgaggaaccctgtctttttttcttgcttcatctcatagttgaaagatatgggaaattaacatggagcatcttcacagagcttctttactagaggtagggaggaacattgccatattaacatgatttggggaaataagaaagtatgaatcacgaaaaaggggaggaatacttttagacattggtttaaattaatgtaaatgcatttaacgttaatgaatttgttatgtcatttttttataggcatatgaagagtctggtcacctttacaaatgtcatccctgagtggcacccacttaatgctgcccattttggtccatgtaacaattgcaacagtaaatcacaaataagaaaaatggtattagaaaagtgagttaaaattgtcttataatttttagtacaaaatgaaggtggatttacatttttcttaatgtgtaggattgaaaatggtgacaacaacttacctttctgaaatttgagttaacatatatttctgggttgccagctgcctcgctctatctggccagtgagcccactgtcacggtgaagccactgaaaagccaacttaggctgactctctggccccactctcctagtgtctttccttctttttgccttttttctccctttaaggatatcaagcttcagtttttctctcctctgccaagtgtatggagtttctagaattctgggatttccttaatcagatttcaagaactaagatgattcaaagataagccacaggctcatctctctgaatttccatcttctcctagatctcagcatgctaattcctcatcatcttgaaagctatctagtggccttgagcagatatattttcattgtattttgccagcttttctgtttgtcctcagttggggaggttggtcagcattaccttttccagtattaccagagaaccatctgtttaaactcacaggtcagttccatctcaggccgtttccctctgtctcattaatgcactcacacatgtacacaacctctctactcttcattttcagtctaatcgtacattaaggaaatgttttgaggtctaatttgatgtaataaagaaccgggaacattaacctttatgcccttgaatgtgccagaaacccttcagaatctttcctaaaggtttattctcattgaagtaataaatcctcagtttatcagtgcttacaggctcaaaagggaaaaagggcagtagtcccctgttccctcctccaggtatctactttaaaccttcaaattaaggtagtatttacttttacttttcaaattgatgtgcctattctaccgtaatgcagtctgttctccttttatagtaattgagactagggttctcacaccaacacctgggccccatctctgtttagcctttccctgtcctttcaatgcaattgcgtatttggctaactcagtactcggtgtttgcattgttattaatatacatgtgttattccctcttcagccaagcagtatatatagttaggtttcacttttacaattcttatttttccgggaattgttatttgccttgttttcatttgttttattatgtactgtgagtttttgccaaatactttaaagacttattaataaattttcaatactcagatgcttcacagttttttactctgttcctctcccctttttttcctggaactctttcctgccacctttcactctttgctgcagtctgcgctggttcctctctgggcctgcagcatagggtgctctttattatgtacacacttccagtcactatcgtagtttttagcccaaggcctcatccccacattctatcacatctgttgcccataaatatccagtcctttaggggttctctgggaaaaataagctcttctttgtcatcaacatatgcactccgtagtactcatgtcttcactttgcccgttctgctgggtaaggtgccacttctctgtttgctttctgtcctctaaatatttgacttcttatttgcttattttcctttctttgtccttttggactcatatcttttttgcccctcactattatttgatagcatttgtgtaggagggcgaagtgggaaggaagaggaggtgtctgtatctgtctgaagattacagaagtctgtaatctgtcttggctgccaggtgtcagttttgagatgtaaatgttgatgatgaggtgaggagaagagcagcagagcatggggtctgccatcctgccttggaccatggcctgctttaggctgcttggtgtatatgatttcatctagctgttcatacctgctttttcctgtgccccagcactgaacatagactcgtaccattgttttgtgtaatctgttaattggttgcactgcagcatatatattttttaactatacaaataagttgcttcccttaaagattcatgctctgatctggaaatggattcattaggtaaaagtcttttaatggaaaatgtgttttgagttccagtgggccaatttatgagcagaatttataatgtgggcatttcctgttttcttcaaaagtaaattgaactagtgtatgaagtttcacttaaattttaaatgccaaggtctttatataagtcctttgtgtttttttaattttgaaatttgtataacttgatttgtttgtgtctaatggaatttagaaataaatttaatatagtttttagggctaacctaaaagtaattgggttcatcatggtgtcatatgtaattaaaacatatagaatcctaaaaactaattaagttccttggacaccttatctcacataacccacatctctaatgtctccccattgggaaaagagtccattgataaatcaggtgaattatgcctagcgggcccaaatctgctacttttctttaagttgtttaggagttacattcagaccatggtgacatggagcaccaagaacttagaatcagatttcattttacttgacaaactcttgaaaggtcactgccacagtctctcttgagtgcaaggctatggctatgctttgtagcacagggacgcgatatttctctgctatctttgggtagcagaggttaacacagctcccttgtgctttctttctctcttttctattttcttttcttttcctaaggatagatctttaaataggaggagtttaaccccatgttaggtgaattcaaatggatcttagcctgatgtctcttgttctcttttggttccagtttggttaattcctttcatccaattttccagtggttgagggagaacctaacttgctctcctcgactctgagcatcatccttcactgacagttcaggcattgtgggtaggaagaagtctgagaacaaaacctagggataaagtttagtagagatggggtttcaccatgttggccaggttggtctcgaactcccgacctcaggtaatccacctgccttggcctcccaaagtgaggctggaaataagacatgctggaattgtaagtaggacactagagtctaggggaatcaaagaggaaaatgaacagaaaagggaaggggaaggatattatttgattgactccaagatgctactgtttgtaagttttaccattttaaaaatatgccattaagaaagaaatgctggccgggcatggtggcttatgcctgtagtcccagcactttgggaggctgaagcggacagatcacctgagactaggaatttgagaccatcctggccaacgtggtgaaaccgcatctctactaaaaatacaaaaatcagctggatatggtggcacatgcctattgtcccagctactcaggaggctgagacattagtactgcttgaactggggaggcaaaggtttcagtgagcagagattgtgccactgcactccagcctgggcaacagagtgagactgtctcaaaaaaaaaaaaaaaaagaaagaaatgctgcttatttaactgtgttctgtcaatgttaaggtgtatcccgacttcagagatgttaacaaatgggaaaaaatttggaattcattaggcatttggaacttacaaagtttcggccgggcatagtggctcatgcctgtaatcactttgggaggccaaggcgggtggattacctaaggtcaggagttcgagaccaatctggccaacatggtgaaaccccatctctactaaaaatacaaaaattagctgggtgtggtggcatgcgcctgtagtcccagctactcaggaggctaaggcaggagaatcgcttgaacccagggggcggaggttgcagagagctgagatcgtgccctgcactccaacttggacaacagagtgagacgccatctcaaaaacaaacaaaccaaaaaaaaaaaaaaaatttcatagttacagaaagtagtatggaggccataccgagattttcgacatggtagtaaaactctgcattatggctctgttctgcatcatctctgttctgcatcgtttcactccacatcagaccctggatagctttggtgtactggtcgatcttgtggcagtaaggctagtgtaattaagaggatattttaaaacttaacatataattgctctagttgttgtctcttttttgctggttaagaaaatcaaatttctatcctatctgaatctcatagcagactttggagatttctgacaagtcatttcttactacctaggggaatgtacttgtactcagctagagtctgagtatcttctacatccagggaattgggctgagtgtggattttggtcttggcagtttttacttttattaatttgcaaaagaatagaagacttggaatgtacaagaagcataaaaatgtgtcaggtggttttacatgcgttatttatcacgttaatatgtcttaagatattttccacgtgtaaacttatgtaaaggcaggaaactagtgagatttcatattctagggatcaagagattgttttagtaactagcctcagaaagtatcttgaaaggtattatataaggtcaaggaactaaatattagtaaagagtcaggccaggcgtggtggcttatgcctgtaatcccagcactttgggaggccaaggcaggcagatcacttgaagtcagcagttcgagaccagcctggccaacatggtgaaaccctgtctttactaaaaatagtagtgtgtggtatggtggcgcatgcctgtaatccagctcctcaggaggctgtggtgggagaatcacttgagcccaggaggcggagattgcagtaagctgagattgcaccactgcactccaacctgggtgacagagctagtgtctgtctcaaaaaaagaaaaaaaaaaaggtcagataggtgcctaaagcctgtgtgtctcgctatgagaatacatctcaagttttactgtggttcattgattcagacatgtagttcacattttaacctgtctgaaatggtaatatgtgaaattgatgtcatgatatagtttaattggcagcatgttttcatagtggtacattttataattagtgaaatcttagatttgatgaaatagatatgattttttaaagtgggaaagtttagtgttatagacagtttgcaggactttttattttgtaggtacttaaattttgaggacttaattattctctaataaagtgattgacaaggattaatgtataaattataccttgtcagtctgaacaatctgcagtttggacattgattcaaattcatttaggctgaataaattttgataaactaagtaagttttgacagctatttaaatattgggaaaggggatattcaacatttttcttacatcctgagagctttgttaaatttagttatttgagacccattgggttctattttctggttcagcatgttgctgtaatggtaaaatacaattttgaaattatagttgtcttgaagttaataataaattgaccaatatgttgtatttttttctctacttagttacaaattgaacttttcctaagtagaacttttaatttgacaggccccctttgcttcctgaggtaactgaaataggccaaattaatgcttttttgaatatcttaggtttgttgctttctttcacatgttacctaccccacttaacaaaagcaattaatctcagcacttgatgccaaagaaaattctaaaaggtctggattttttccttggattttacaaagtagctacaatgggacttttaagacaaagctgcattgctgcttacagagcaatttttgtttaatggtctgtgttagagtcatactgcatgatgacttccaactgtctgggataccattctgaaaagggtttagtgttacatacttcttagagagagttctccatttctaattaaggcacacatctggaggtgctcaagaaaaattagtgcagttagccttggaagtgttatgtgtgactagttcacttcagacatcttttgtataatcagacacatggcattaaatttatttaacttctcttgcttttctctcccacagagtatctcccatattcatgttgcactttgtagaaggcttaccacagaatgacttgcagcactatgcatttcattttgaaggctgtctttatcagataacttctgtaattcagtatcgagcaaataatcattttataacatggattttagatgctgatggtaagtgtttagaggttttcttttaagataattggcatagaaactaaattctagcatgtggggactttttggtttttgttttataaaaaaagacaaactttgtcctgactctttctctctccattctcgcctttgccttctgcccctcctcgcatctattaaaagtgatggttttagtatcctgtctcattttttcctttccttacatcatgtattataggtaaacacatgcgcatgtgtgtatttctcttttagacaaaggatgagattactactgttagctcagtttttttttccctacttaacatctttgcttttattttttagacatatttctaagactattaaacattagacttacgtagcccttctgtcattgtgaaatacatagtttactaacagctaccatcaagataaagcctttatttaaataattaaacttcttagtggaaagctaagtaagcacagtttatggattttgggaatttttgccttgcatttgtctgatatggtaaaatattgagtttgtttttctcataatgttcactttgtcttagacaagataactcaatccccttaaagggttgtatcaagccattgataagggctcactttgatataaccattttctgttatttagacactctttcacacttcctattttcctcctggggatggtttgaatggatgacacaataccatattataaaagcactttacaaactgtaacttatgttataaatgtaattattaccttaaggttttaccctgtttcagatttgagtggaagtagttctttacaatacaaaacaacttattttaactttttttgcatttcaaagaatgatcaatccacttcaggtgcagcatggtttccaaccctgacagcatggaagaatcatttatttagcttctaaaaatgtgcaggctgtaccctagaccagccttggggattaggcccaaatatcaatgttgggtgtttttggtattggtttttggcccgcctacccgcccttccttccttcgttcctctctctcattctctctctctctctctttctctctctccttctttgctccttcattccttctctctctctcttttttttttgagacagcatctcactatattgcccaggctgttctcaaactcctgggctcaagtgatcctcctgcctcagcttcctgagtagctaggactacaggcacatgctatggcaatactgttttaaacattgttttcaaggctccccaggtgattccagtgtgggtcatgtggtagagaaccactgacacaggcaaacaaaggatacataaagttgtctatttaatgggtaggtgcaggtagtagataagagtgtagccacataaaccacatgcttagtgaacggttttgttttgtgtgtatgtgagggattagcatctctgagtatattttgttttcccttttgaaacttatcagagaattcatatgtctgttatgtgactaatgctcacattaaaaaaagttatgtgactttttttaattcatatgtctttttaattcatttattcattcatatgtctgttatgtgactaatgctctcataaaaaaagtaatgctcagtttactttttttatatcagatcatatatatatgtttttttttttgagatggagttttgctcttgttgcccaggctggagtgtattggcgcagtcttgtctcaccaccacgtctgcctcccgggttcaagtgattctcctgcctcatcctcctgagtagccggaatacacgcaggcgctaccatgcccggctaattttgtatttttagtagagacagggtttctccatgttggtcaggttggtcttgaactcccaacctcaggtgacccacccgcctcggcctcccgaagtgctgggattacaggcatgagccaccgcacccggccatatcttatattttaataaatattttaatttggtctgtaaatttttctttttggggaatgtgttttaagtctgtgttgagtcctagacatttgttgttctcagatagtcactagtgataccttaacattaaccagcctgttggcaactaaattggcctgaagtgacaactaaggaaaggtctctttctcctttcttaatctttgcattccttaagattagttctttgtaggaaggctttgaagtctggtggcaagtaccctttatccctcacaatcttaagataaggtctttctgagcattaaaaagtgactgtgggagatatgtcaaatgagttttctgtgtgtgctctgagaaatctttttttcaaaaaaggatagatgtacttgtataaggaaaagagaaactgagcgcactttcaatatttaagtaagtgtctctaacatgttttgcaacataaaatgatgaccactgtgttggtcattacttctctactgctaaaacaatgttttctaaaataatatactccttagaaaaaaatatagtgctttgggtgtgcactgttgtaatccaaggaataggaaatgttttgtagtaagtgcgatggtgtttgacatcgtgatttattaatttatcacatttggtttcatagaaatagagtaagctacgtatttgctgtgccgcaattaccatgacattacacttgtatctatttctgtttcatagatgtgtagatattgatatatacagtggaagtatggattgttttgataagtttctaatgaaagtacagatatttgttgattatttattaagaaaggttgttactcatccaagcccgtggttagcttttcccaaattatcatgtggtagtaagtaaaatgtaaagaaatataccctcccttaaccccacaccacctgttagcacctagccaccttcctttacttctcagccgtactttttgtatttttttgttgtagtggtaaaatataaataacataaaatttaccattttaacatttgtaagtgtacaattcattggcattgaatacattgtgtgcaaccaccatcaccatcaggactttttcatcaacccaaacagaaactactcattaaacaataactccgcatccttccaccccaaagccctggtaaccactattctactttctgtctctgtgaatctgtctattctagatacctcatagaagtggaatcgtacattatttgtccttttgtgtctggcttattttactcagcatattttcaagattcatttgtgttgtgggatgtagcagaatgtcattcctttctaaggctgagtagcattgtatgtattatccatttatctgttacggacatttgactattgtgaataatgctgttgtgaacattggtggacaaggaactgaaagtccctgcttttcattctttttggcataaacctacaagaggaattgctgggtcttaacggtaattctgtgtttaatttttggacgaactgccagactgtttccacagcagttgtactattttacatccccaccagcgttacacaaggattccaatttctctacatccttgccaacatttgctattttctatttttttttaataatatccatcctaatgggtgtctttttttttttttaaaggaatggtttaaacaggttaccttcttactcctcattcatgctttagttgactacataaggacccctctccctattggcaccattgaaattgttcaggcaaaaataactgccagcgacacactgctttaagtaatggacttttcccaagttttgtattaatatttcagtatttggtagtgcatcctactgctagtttttaaactcttcccttgtcatctatcatctcattctctcttgacaaatgtgaaaatggaagctcagaaataaaacaagaattaaaacgaatagtgatccttcaggtaacaagcttcatttatcatgaaaacatatatgtatgaaacattctgttttctgatgttattggataaattaggtgataaccaaattctaagttccaaaaattaaatatactctatctaaggactttaacatggcagacaatggtgacaaggtcaagaacatgttttagagtcttctcctttggtcggtattcaatgatacaacagttgaaaaggccagaagaaagttaacctaggatggtggtttttgaatatctaactttcacttctttcccatcttccaggaagttggctggaatgtgatgacttaaaaggcccatgttctgaaaggcacaagaaatttgaagttcctgcttcagagatacatattgttatttgggaaagaaaaatatcccaagtgacagataaagaagctgcctgccttccacttaaaaagactaatgaccaacacgctctcagtaatgagaaaccagtatctttaacatcgtgttctgtgggtgatgctgcctcagctgaaacagcctcagtaactcaccctaaagatatatcagttgcccctcgtactctttcacaggacacagctgtaactcatggagatcatttactttcaggtccaaaaggtttggttgacaatattttacctctgacacttgaagaaactatccagaaaacagcctcagtttcacagttaaattctgaagctttcctgttagaaaataaacctgtagcagaaaatacaggaattctcaaaaccaatactttgctatcacaagaatcactaatggcttcttcagtatcagctccatgtaatgaaaagcttattcaagaccaatttgtggacataagttttccatcccaagttgtaaatacaaacatgcagtcagtacagctgaatacagaagatactgtaaatactaaatctgtgaataatactgatgctactggtcttatacagggagtgaagtcagtagaaattgagaaggacgctcagttaaaacaattccttacaccaaaaactgaacaattaaaaccagaacgtgtcacatctcaggtatctaatttgaagaaaaaagaaactacagcagattctcaaaccacaacatctaagtcattacagaatcagtctctgaaagaaaatcagaagaagccatttgtgggaagttgggttaaaggcttaataagcaggggtgcttcttttatgccactctgtgtttcagctcataatagaaacactataactgatttacaaccttcagttaaaggggtaaataattttggtggctttaaaactaaaggtataaaccagaaggccagccacgtatccaagaaagctcgtaagagtgcaagtaagcctcctcccatcagtaagccaccagcaggccctccatcgtctaatggcacagctgcccacccacatgctcatgctgcttcagaagttttggaaaagtctggaagcacctcatgtggagctcaactcaaccacagttcttatgggaatggtatttcttcagcaaaccatgaagacttggtggaaggtcagattcataaacttcgtctaaaacttcgtaaaaagctaaaggcagaaaagaagaaattagctgctcttatgtcttccccgcaaagcagaacagttcgaagtgaaaatctagaacaggtgccccaggatgggtctccaaatgattgtgaatcaatagaggacttgttaaatgagctaccatatccaattgatattgccagtgagtctgcatgcaccactgttcctggtgtttccctgtacagtagtcaaactcatgaagaaattttagcggaattattgtctcctacacctgtttcaacagagctgtcagaaaatggggaaggtgactttaggtatttgggaatgggagatagtcatatcccaccaccagtaccaagtgaattcaatgatgtttcccagaacacacatctgagacaggaccataattattgtagccccaccaagaaaaatccatgtgaagttcagccagactctctgacaaataatgcctgcgttagaacattaaacttggagagtccgatgaagactgatattttcgatgagtttttttcctcctcagcattaaatgctttagcaaatgacacattagacctacctcatttcgatgaatatctgtttgagaattattgaattaatgcttgttaacttttttcatataatatttattattattagaagaacttacaatgtgttcaggtagtgtttatacactggacttgtgtaattacttgtgtaataaccatgaacaaaatgcaaggtttaacctttggttctgcccatgaagcatgtaatctttcttacacattaaaatcactgaatgtgttctcctttttggtttcattttgttcttgtgagagtatgaggatttcaaaatgttaaagatgaaaagtggcgtctagtttctgacagtttgtacagttggatgcattacatttttagatttgaagttttggttatgttagtgttatgagtgatctttgtggtggttttcttcccctggaaacctgttgctcgtggcgctttgcccacggtgcccgagttcttgtcctgtgtccagatatgcagacaaatgaagggtgaagaagaagaagaggagctttatttagtgttagaacagctcagaaggagacccacagtgagcagctcccctgtgtcggcgggcaggtcgtccctcaagtgttcagctctcagcagagaaaaggccctggagagggtgactcctctcagctctcagcagagaagcagccctggagaaggtagcttctgttcgcaggcagattgtccagaggtcctgctgctctcagacggggccctggagaggatagcttctatccataggcaggttgttctgccgtctctacaggtctctgaagctcttagcagagagggtagctcctccctgttgctggtcgtcccaccctctgctcagttctggctgagcctggggcattttacgggcctcgggggaggaagtgcatacttactggcctggaaaaggcaccagttcccactcctacaggtgggactggcagcctggccctcagccttcaggccctccctgttcatggcttccaggcttacccccctgctttgatctgagagctggtgccaatagcagggagaagccaagctgcagaggcaagcacttccgagcctgcaaaagcaggcccccaaaagtgcagggatgcctgagtctgcacccgcacccaggagggtggagatcttgcctgctccaaggctgcagccggaatgatagcaggctgactggagcacctgccaccatcattagttcaagagtttatgcagatttaagttgtatacggtatatgaatgtgtgacagttttccttatggttgtgtggccttctgtaagagcctacgcctgtttgttacaccggtagagtgctgtggaatgtaaactttccctatgtcacttatctcctttatctctccatacagaggagggcaagaaaccttgttacttgaactttagtaatgttaagtgatcaataaatctataaataaatgatagcagaaaaaagttacctgtttttgtgatgatgtacaaactttacatgttatcacaaataccatctttcttcccaagacatttacttctgtaaccaaagtgggacaccatctaacagttctgttttgggagagagtaataaccagtgcttgtgaggcttgttagatgttggttgtgatatatgagatagatgttatttcatttagacctcaacattcctgtgcgtgagatacttttatcacatcttacagataaggagactgtactcattcagttgtggagctgagattgagtagagtggctattacagcagttgagtgctgagcttatcaatatatgttccactcctcaggcttcatttaaagtaggatgcccaaacagcaccactgccgtagagatttgagttaacagcagtacttactgaggtttaaggctggcagccagtgtccttgcagtaaaattatttgctagggactcagtacttcataatctatttgtcagatttactcctaagcttctgtgttgttttattttttttctgacaaaagtagtgcatattgtcaaggaaaaactaggaaaataccaaaaaaaaagatttttgaccatgcattttaatacttagtgactacaaacattttcctattttatgcatatagattttaaataaacgtgagatcctattgtatctgttttaatggataaacattgtttcactgttttaagattctgaggtgatttatactgtcttgccattgttaattgcagcagttagccttgttgataaatttttgcatggatccaagttttgttttccaggagtggagttgcttggtcaaaggaaatgcacatttaaggttttttggtgattgcatgactgacttccctgggccctcgccaacactaggtagtagtattgggaggaaggggggaaccaatcctgggtgctccaagattactagtgagcctgaacattttctataactattgtccacttgagttgttgttttgttttttttttggtggaggcgggggtgggtttaagaattgcttatcctttgcttgtactaattatcttttcaacaaatatttctagattactgctaaggaccaagcactgttatcagcctgagataaggcagcacactagaaggaaatccttgctccttttgagtttgccttccaaacatggagatcaatatataatgttaggtagtaataggagatacatgcagttgattcatgtcatttgtagtagttatggtcaataaagttgccttgaacactgaattagtataaactgaaatactgttcctaggggaaataggttcctgctagcctgtggtcatgagatttttgtcaaacaatcactatataaccttttctgtttctgtttaaagacatgttatttgatctatatggttgattctttacattaacatggccaacagcactgtaactcagcctgaacgaagcttatctgacacatggtgttctccataaggcacatcatagctttctgtgcttaggaacactagacggcacttcagcactgcacttgaggacgttttaaacagtgaaatcaacaaaaagcacaaaaaaatgcaacaataggctgggcaaggtggctcacgcctgtaatcccatcacttagggaggccgaggcgggcggatcacgaggtcaggagatcaagaccatcctggctaacacggtgaaaccccgtctctactaaaaatacaaagaattagccgggcgaggtggcaggcgcctgtagtcccagctactcgggaggctgaggcaagagaatggtgtgaacctgggaggcggagcttgaagtgagccgagattgcgccactgcactccagcctgggcgacagagcgagactgcgtctcaaaaaaaaaaaaaaaggaacaataacaaagacactagtcccccaaaaatacacttgtttacagtgtgaactgaaagaggaaggtggagtattgacttgtttgacctcagctggaaatgtgcacgtcctgtgactcaaatttttctctgttctgtgcatgcatgtccacgaataaccacaagaagcactgaaagcattgatttttagggttacaaattaattttagcaagtaaatgaattcacaaatacggaatctgtgagtaatgaggactgattctttttttttttggagatggagtttcactcttgtagcctaggctggagtgcaatggcatgatctcggctcactgcaacctccgcctcccgggttcagcctccacctcccgggttcaagcgattctcctgcctcagcctcccgaatagctgggattacaggcttgcaccaccatgcccggctaatttttgtatttttagtacagacggggtttcaccatgttggccaggctagcctcgaactcctgacctcaggcaatccacccacctcagcctctcaaagtgctgggattacaggcgtgagccaccgcgcccggccgaggactgattcttatgtcagatggcactaaatgctatggagaagaggagtggatgagagggagaagtattttagaccaggtagacttggaaggtttcttggaggtgggtgatgtttgagaagaggcttcaataaagttagggagctcgccatgtgattgcaggaagagcgttccaggagaacaaaagtcatgaagagtgagtgctaggcatgtgtctggtctgtttgggctgctataacaaaataccttagactgggtaaaatgtataaataatagaagtgtattgcttatagttctagaagctgggaagtccaagatcaaggtatcagcacattctggtgaaagctgctctgcttcatggctggttctctcactgtcctcacatggcataagaggggcacagagccctcaaccgtctctccagtggccccatctcttagtactgttggattggggatttagacttcactaattttggggggacacaaacattgagaccacagcagcatgactgaggataagcaagaggccagtgtggttgagcagagtgatcagtgaaggagagttaggacatgagtaaagaggctagcagacaccagatctcatatggctttgtaggccatagtgaggactttgtttaagctgagaataatagataacctcaggaaagtttcaggcaagagggtaacatgatctgatctgggttttaaaaggatcactgaagtggggagactgtctacagatggtctgaataggagtcctagtctattacaatctccttggagtttagggtggtaactggaggtgttcaagagtagttggattactgttggatttcaaaagtagagccaacacgatatgtgcattggctgtgaggtagaagaggagtcaaaatgaactccaggttttattgactgagcaattgtgccatttcctgagatgggtcagatttgggaaggaaagaatttaaaggggataagataatcccattaggagtgtgttaagtgtgagattcctattagactttcgagtggagatgatttaataggaagatagatctgcaacactggagctcagcggagagggacaccctggagatagccgtttgggaattaggaatgtgtggatcatgttataggatggggtcatttagggacttaaaacagctctgaagaacaaaaatggtgccttgatcttggacttcctggtttatagaactgtgagcaatatatatatatttttttcaagacagagtcttgctccgtcatccaggctggagtgcagtcgcaccatctcggctcactgcaacctccacttcctggttcaagcaattctggtgcctaagcctcccaagtggttgggactataggtgtatgacaccatgcccgactaatttttgtatttttttgtagagacagggttttgccatgttggccaggctggtctcaaactcctgacctcaagtgatctgcctgccttggcctcccaaagtgcttggattataggcgtgagccaccatgcccagactaaatttctaacatttataaattatccagtctaagatattttgtgatagcagcccaagcagaccaaggcaaaggccaagcacacttgctcctcctgacttttgctcttcctggaatgttcttcctttagtcacatggttgcctgcctagcttcattcaataggagtgtggtgccctgaaaatacaaggaagaatgcttttcttttttttaaaaggaagggatgattatctgtcagatgctgctgaaaaagagtaatagagtaattggccactggctctggcaatagggaagttagctctgctaactccacatgaacagtttcacatgaacaagtgtgagtgggctcaagagaagggatggtgagaaagtggagctatggactcactcttgaaacattttctggtgcctcgtagggcaatgtgaggtcaaggtttttgttactgttctgaagatgggagaggctgacacatggatgttgtaggtgagagaaggggcgcttgcgggggcaaacttctccagggatgggattccagtgtctaagaggaggcggtgtgaccctaagagctagaaaaattattttattaataggaaagacaaagtacttaggctcagatgctaagagatttgctgataaaagaatgagaacggtctcttctgattattttcttggggaaataaatagatcatcagctgagggtgtgaggggagaaggagttgaacatggaggaagacaggtgtgaaatattggtctcagaatggagagcgaattgaatagggacatgcagtgggcttgctaagctgtgcggagagcccgtgggaagtttatggtcatcaatttaatggcgaccagccaagatggtggtttatttttctccagttgtatttaactgctcaggtgcaggacagagagactaagtgtgaagttaatttcagccaacgtagaggaattgtcaggcagatgggacaaggagatagaggagaaaaggaataaggcttcctgcaagggtaatgattgtagggatggataagtaaggaacacaggaagtggctgtctgctgagtggtggcagagctcagtgggtcagagcaaggttcaaagaatggcagagaggcacttgtggaggaagtaagctggctagaaagtagtgtgcttgaaattaagcttctggagatagcaaggttacaggtgatgacaaagtctgagtatgacaaggaaactgcagggccagagttggcaagaattcatgaaaaatgaggagaaagaggcaccaagaggctgggatagcacatggattgtctctgtgtgaggcaaagtcatctaaatggcagcagtggccctagcagaaagaaatatacagtgagccggagcaaaaatcctcaaggacaggcagaacgccatgaaaacggcagatgacagccaaaggagcaggggcaggggctcagtccaaagtgtttcagagtcactggagggttgagtgggaaggggagggagtggctgaaatggcaacaaggaagaacctctctcatctccaggcccaaaagtatgtggaatgcgggagataagacagccaccactggccagggctgtaaagggacattcagcgaatattcaggttccatttagcacgacagcagggaagggactgttggcagaaaaaaactggggcagtgggattaaagacagaccacacattccaaaaggcaccgtgggagggtcagggggcgaggttaggtctaggcttcagtgtcctgggagactcagtcttcacagggtgacagcgatcaagagtgcagcttaggctgggtgcagtggctcatgcctgtagtcccagcactttgggaggccgagacgggaggattgcttgaagccaggagtttgagaccagtctgaccaacatggcaaaaccccatctctactaaaaatacaaaaatcaactgggcatggtggcgtgtgcctgtagtcccagctacttgagaggctgaggcaagagaatcacttgaacctgggaagcagaggttgcagtgagctgagatcgtgccactgcactccaacctgggcaacagagtgagaccctgtctcaaaaacaacaacaacaaaaaagaaaagagtacaacttatgaaggggtctcctggggagagggtttttgggattctcctgcctctcaaagtgctgggattatgggcgtgagccaccacacccagccgagggaggctgagttctaattgttgtatctctcttgggattggcctcctgggcagtttaaaagacaaggcaaggaatcttttggagaaagagactgggggcaaggtgtgtctgaacaagaagtgtgagaagctctgtgggctcccttcagacttccagtcgttgaattgggatctcatttatatcagctctaggtgtaacgatattaaatcttctctgtcatttggcaattttggtttatgcttgatcatcatttttaatgtttcgacatgtagaagtttaacattattttacattcttttccttctggcatcatgttttagcaagattgtttccaccaaaagaatatatatatcttctaatgaaactacgtttcttttttttttttcctttgctttctcttttggtatatgaatctttgattatttgtaatgtattttgatgtgtaacactgaagtttctattttgtactatttttttccccaaacagtaaacttattgttcaaatacttattgaacaaccttcactattctttaaccatttagaatacgccattcacatatctttcatactacatttaataacattttttaattaaaaaatattctactgatttgtttattttgagaccaggttatgaaactggctaatttttgtatttttgttaaataccgaaattcactgtgttgccaaggctggtctcgaactcctgggctcaagcaatctgcccaccttggcgtctcaaagtgctgggattacaggtgtgagccgctacacccggccacacccggccaacacatattatttgttattacatttaattcccacagtacattgaaattatcagggaaaagttttcagtgaaacattattgaacgccacattaaaagtgtaaattacaaagatttaatgccaatttttcagaagaaaaaagaccaggaggaaggtctatgaagttttagccagtctctcatccacctaccatttcacgatcatgcactgtgtaagtcaggaaaagagtaagaaaagtgaaagatacaattgattagagagttttgctggatactatagatgaaaagaacacaaaatggaacagcctcttcaagcttagagtcaacggctgtagtcccaaagactgtagtcagaggcggtagggccaaaagacatgacttatggcattggaggaagaggatgctttgggagttcatggtagaagaggcggaaaaaatctggtggattaaagaaagcatcccaaagtgacattaaactaatgactaaattctgagctgttttcaggggcaaagcctgtttgggcacccctgccacacttaaagagtcacctaggtatggttcgtgggctctgaacaggcctgctcagtgaacatatttgtgactgtttctccggcccttttagctgtattgagtaaaatttaaagagaccattgttttggcctaagctcctgccctaggcccaaagaacagaccaaacctgaatggcttcacttgtcctaggtgctgtgtactcaaactgaactttgaaacaggtcggtttttcaaaaaaagcaaaagattcacagcaaccaattagaagaggcccggtcaacctgagccagcatgatgaggctcttctgctttaatcctacaaggaaagaaactttgaaatgaccaatctgctttcattcttggtttctgctttctttggtctatttctgcctgtaaaacctatctcctctgctcagctcattgaagtacccttctatttatagatgggatgctgcccgactcatgtatcgctagtaaaagccaattaaattattacactcgatttgttggaattttgctattttgacagcttttcaaaaacaccagtaggttcacatccctaattccccagccagtgttccctcaaggaaccatggaagaagcaaaggtggctgaaaggcgcctcaggatgcttctaagcacggcacatccatgaaaaggcacttactaatatttgcaggatagcaaagcactgcagtgacgataaatctagtattggagaagttcaaaataatcagtagattaacacagaagccagagcttatagggagaaaaggaaccctatgaaatacttcaaatccgaaaacgaacatgcatttcctgtttagttagtgcaggtacgtaaaagcttggtaaagtacccttcttgccagctttctctttcttacaagccttttcactgggctgggaggctgatattatctaaatatgctgaggaggttcaagtatctccacaactcacctcagagtgaatgctcccctcggccttaaggcaatataaaccagccctgtttagcaggatagcaaaatgtttgcggttgtaaactggtgtcccattggctgtggcgcttgtggtgtaaagaatccctgtgcttggtaattaatagagaaattctatattttaaacttcagttgtatattggctcttatccatggcagattttcacgtatgtgttatttttttatttattcagagccggagtctcgctttgtcgcccaggctggagtgcagtggcgcgatcttggctcattgcagcctctgcctcttgggctcaagcaattcttctgcctcagcctccctagtagctgggactacaggtgcatgccaccacgcccggctaattttttgtattttagtagagatggggtttcaccgtgttgctcaggctggtcttgaatttctgagctcaggcaatccgcccgcctcggcctcccaaagtgctgggattataggtgtgagccatcatgctcggccctatgtgatatttattacaatgaattccaatgatcagacctatactcaagtataagtgaatatatcattcaatgaagtataaatgatcattatgttcatattcacacatacaataatgtactcaagtttattgctaaggtaattcagaatctccttattttgaagtgtgcatttgatatacctgtttgggaataactagtttcttatctttgacagaaaataattttgttgttttgtttttactaaaaaagcatggtgaaaaatggctccatttctaagagaggtaactaaaatatcgcaatttgctgggtgtcattaaagtaactcacaagggaaaaaatgcaaattggtatctgctgatggagtaaatctccgcagaagtgatgaccctgaaaggatcaatatattaaagcccctcccagctggtcattccagattgcaacaataaagcattaagtgttaaaacctcaaggcagctttttttttttttttttgtctcaagtcctttattattaattttatagacctacttaattactaagccaaaaaaaatcaaacttgtttctctttgtgacttgtcaatagtattaaactattctggttttttatttttgtgttaccttaaagtctccagtttagtaatttttctgtacctaaacacttcggatttgacatgctttgtggcctttatcagtagttagaatgtaaatccaataaataaagtaaaagccaggtcttcaaaacctgggggccaagaactctgttttagagggcctgtgactctcttggacactggacaaaatctcatctctaaatatggatattttagggagagggtctttaggctgtcatttggattttcacagggctccatgtatccataaggtagtctcttgggaagtttgacttcaataaatgaagtttaacttaaacctaaaatgaaatttaactgaaaaacaaaatccaatgaaagatgctttcttatgcaaaaacaaacaaacaaaaaaaaaacaaaaaaaccccaaaaaacccaaagccaaagattgtttctgaaattaggttctaggttccagagcaactccatggtggggaatcagccacatgtaaagtaagctaagagtttggacaatttgtaatatttattcctaggtttctttaagaccctttcagattttgaattcctattagtagcatcagccaggttctaaatgtaggcatcaccatagacacttccccactgctgcagtccccaacacttgcccaattttcccttgaattgcacccatgctgccttctccaggcctatttgaacccagaacctcgttgtgcctcgtttgaaatataatttcctcctaactagtctctgatctactatttcccctacattgctgccacactaatcacctaaaatagatttcattctaccctgaaacagaaatctctaataagttactcccttcccttacggggtaaagttagccacatcctaggtattcaaggaccttccaggagctaagaacatttcccctgcaccttcttgaagtacacttgtcctatgtactggttatgttcatttcttaccctcgctctcgttttgtctggaattttccttggccttaaatgcctctcacctgcctgcccacatctctcagggttgtttcaaatcctcaatgaaggctcacagccccagtctatgttggccacttacttcgtggcctgggaacatttttctttggctgacttgctgacactccatcagatgcatttttatctggttgtccatctgtgaaccataccctgagaaggcagagagtgcctctgcactgaacatgtgctaggggacaggtctgtgctagaggggcaagcactgggaatgaagaactggtccctactcccaaggagttcatatctcagtggaggtgacaagcaactcactgtttccgggggttgtggtgactgctgggagaaggggtgtctatattagatcgaagcagcatcaggggaggttccctgagaaggtgatgcctcagcggatgtctcccagctaagtggggtggaggtggagaagggcagagcagggagaggatctaggtggggcgtgtaagtctgcatgggtaactcagggaacccttggtaactgcatgtaactgtgtgaagctttcatgaaggaacatggtaggagactagggtatggactatagaagcccttttgctaagctcaagaatttgaggccgggagcggtggctcacgcctgaaatcccagcactttgggaggccaaggcgggcggatcacgaggtcaggagatcgagaccatcctggctaacatggtgaaaccccgtctctactaaaaaaaaagtacaaaaaattagcggggcgtggtggcgggcgcccgtagtcccagctactcagggagctgaggcaggagaatggcatgaacccgggaggcggagcttgcagtgggcggagactgtgccactgcactccagcctgggcaacagtgcaagactccatctgaaaacaacaacaacaacaaaaaatttgaagtgtatcttgaaggaaatcccttggagcctaaaaatgatcattgataacagaaaatgatctctgctctcgcctagggtaatatattcagcttcaaagtggaagggcatgttttccaagggcatgttttctaagtccctgtaattgtagtgatagcaaatatatgccctgcatcttgaaatgtaagactaggtttgaacagtatataaattatcttatgatctaatttcccctcattttgtggtttctactataagctacccagaagtgtagacaggacgtttggaatttgatgggcatcggaaagattcctacctaagaacatttttttttttttttttttttctgagaaggagccttgctctgtcacccaggctggagtgcagtggcacgatctcagcttactgcaacctccacctctcaggttcaagtgattctcctgcctcagcctcctgagtagctgggactacaggtgtgcaccatcatgcctagttaatttttatatttttaataaaggcaggatttcactatgttagccaggctggtcttgaactcctgaccccatgatctgcccaccttggcctcccaaagtgctgggattacaggtgtgagccactgcgcccggcctctaagaaaatttttgagagctacttgttctgttgcctggaattccaccgtaagtacgacgttgtgtctccttctccagggctactaactaaacaacagagggtattgtgttatcgacaattatttgattgataactatcagcaaacatttgccaaggcattcctttaaagatagcctagtgactctattaactactccttcttccaggcttctaagttctgttggaggtaagtagatcccagagataaagcacctaccataggacctgaatcttggtagaaataaattatatcatcatgttatcatattatcatgtgtttttctatctttaaagtcttatgtgaatattctgcttgaaaaatatgtgtcctctgttagaccagagttgaaaatatgttattcaagaacttgtaacaggaacccgcacaatttctgctggagtttaatttcagggttaattctgtcagcaatctaaggtaaacattaacatttttccctagattcaagtccgttgtccaaaagctgtaacagaacttaactgaataaatagtttcttaagatggtaagcttccatatgcttataatgactcctctacacgttttcatctggaaggctgctcatgcttttggaagcaaagaagacaatcttaaataactacatttgctttttggtggtgccagatttttctgagaaacaccaatggaatttataaattcaccagtcaatgggcaattgagttgctgttttgctattaccactgccgtttgtgagcattgttgggaaggtgtcttgaagcacacgtgcaagtttcccttggataagtagtaggaatagaattgccaaaccatggcttccagtgcagacacagtctctcccttgggcccagccactaggcaccacacattaagaggatattgtctgtccatgtcctagaaacgttgtagcatcatgctcctattcgattaaaaatctcattattaaaatgaaccatcgggtaaatgttgtctcgggaaaagaagcactgaccgtccctgggtgggctcgaaccaccaacctttcggttaacagccgaacgcgctaaccgattgcgccacagagacccagttactcaggccgcgctgcggtgtgtacagatttccgcggcgccggcagccgctctagccaccctgggcgtcgccaccccaggcgttgccaccccaggcacgggctgagaagtcgcggggcgcgccgaggaggcagcggaagcggccgaggtgcccagcggccgccgcggggggagaggctgtgccccggcgcgcgggagggggcgggcgaggccgcgtgactccgggcttctctggggacgaagcgcgcccctcgtggcggcagcggccagtggtccgcagtcggcccggactcggggtaggaaagatcctctcagcaatggctgcgcgccatgcgtgctctgcggcggggaccgtgccggccgggcgcgccaccagtaaccagggacccaggggagaacctgccaaggggaataggtcgcacggagagaatacgacacgcttggagggaagaaccacgtgctgtacaggtttaaaggatggagagtcacgtgcgcttaggtcccaaacttaagggacctaaccctttttctgggttgccgctattgccccttctccttagacagtttttcatctcatcacctctcaccccgtaaaatgcaacgaacatagataggctgtgtatcaatgtagactgtatgtatatctgtgcttcgtacataaaaagaatatgatttttgccaccttctaagaaccaatttgcaccccattttgaggcatatggcctctgttgagattgcatagtttaggggacatcaaaaaagccttatagagggactggcaattaagatagcctttcagtttgaaatggccattgaaggcttctccctttccctgacttctgaattttttttttttttttttttttttttttttgagatggagtcttgccctgttgctggagtgcaatggcgcgatctcggctcactgcaacctccgcctcccgggttcaagcgattcctgcctcagcctcccgagtagctgggaatacaggcgcctgccaccacgcccagctaacttttgtatttttagtagaggcggggtttcgccatgctggccaggctggtctggtactcctgacctcgtgatccgcccgcctccgcctcccaaagtgctgggatgacattacaggcgtgagccaccgtgcccggccaatttttttaggcgcactgttcagtggcactaagtacattcacattgttatgcaactatcaccgccatccatttccagaaccttttcatcttccgaaacagaagctccctacccattacacggtaactcacgattcccctcctctagtcggaacaatcaccattctactttctgtccctttgaatttgactactcttagagacctcatgtaaatggagtcatacggtgtttgcctgtggctggcttatttcacttaccatatgtcttcaaggtccatccacgttgtagcctgtgtcaggatttccttcctggataaggctgaataagctgcactgtatgcaggtatcgcattttgcttttccattcatctctccgtgaacattagggttgcttccacctgcagctatgaacatgggtctacaaataactgattccctgctttcaattcttttgggaatatacccagagatggagtagctggatcacatggtttgctattggctgtaccattttacattcgcaccaacagtgtacaagagtccctatttctcctcatctattttttttttaaataatgggcatcctaatgggtatgaagtatcatctcattgtggttttgctctgcatttctctaacgattagtggtgttgggcatcttttccagacaccaccaatctgaattctatggcccttcgtttactcacttcctcccagcaagagccatttctgcttcagcaaggaggaagctgcgactgatagagggaaagggcccagggggcttgcagagtggggcctgtgccatgcaaggagaggagaagaaggtggatctttgagtaggactatctggagatcctgctttcacaaggtccttgcttgtgtgctgggcagcttttggagctagttatctttattttagcccttgagggatatttaggcatgtggtgcttgtgagcagccaatccatgaagaaggaactgatggtctccaccttggaaatattggaagagataatgccgtccaaattgcagttttagaagttaacttaaaattatgctattttaatggaattttgggtgcatttccattttcttcttaagaattgctggaatttcttaagtgtttaggtgatgatctctttttgtgattccttttttaaaaaacaacaacaaaatctttcaaatacataagaaataggccgggcacggtggcgtaatcccaccactttgggaggccgaggagggcggatcatgaggtcaggagatcaagaccatcccggctaacacggtgaaaccccgtctctactaaaaaatacaaaaaattagccgggcgtggtggcgggcgcctgtagtcccagctactcgggaggctgaggcaggagaatggcatgaacccgggaggcgaagcttgcagtgagcctagatcgcaccactgtactttagcctgggcgatggagcaagactgtctcaaaaaaaaaaaaaagaaaaaaaaagaaagaaatagacctttatttttctgtaactccacaaaatttctattttgattccctattattttgctattgtcaacacagtctcagtcaattcaagatcctgtttgtgcctttccctggagtcatttccaagtgctaaggctttggtccatgagtcgcatgtgcacactcatggctgtagagggagttttgctcccggtgaaggtcttggtggctcttctataccttgattgagggaaaggaatcttatgtgaagttagctttgttgtatcagatattccataaagccatttctgggacagtcccctctgtttatcggaccacaagcttctctgtcctcatcaagcccacctttatacttcatttctccagacttcatgtccagactgtgggatgaacaagtggttataaggttttagaggctcctgtaggactagatggaaggcaaaaaaaggaaataacctttaagcatgctctcgattccttaaatcccatctgaaagtcttaaggatgtcttctcagtcatacttatttgacaatattacctaattttctccattagcccaagctcaggggtctttcttcttccatattcacatgggtgcaatggttttctgaaaggaaaacagcattactagggcagtaacatttaattaatcacaggtacttatcaaactacaaaacaggcattccaggaactgggtgtttctgtttgtaaaattacactctcgtgtacatgctcccactaaaatgtaagttcgctgaggatggaggttttggtctctttgctctgtgctgtaaccccaacactgcagcagggcctggcacatagcaggcatgcagggactatgcactgaatcaatgaggaaatgaaaaccaggaccatgaagtaaactggacaaaataaaatgtgatagaaaatctaaattcctaatacataaggagcacttatcaattgatatttacaaaatctttttacaattcaattaaagacaacataaaacaaataagaatggggacaggaacagaaaattcccccaaagaaaaaaatatatatacatggtacagccattgtggaaagcagtatggagttctcaaaaatattaaaatagaactatcatataatccagcaatcccatccctgggtatatatctaaaggaaatgaaatcagtaccccaaagaggtgtctgcactcccatgtttattgcagcattagttacaacagccaagatatggaatcaacccatcagcagatgaaaggataaaggacatgtgatacatatacacaatggagtagtattcagccttaaaaaagaagaaaatcctgtcatttgcaacaacatggatgagcctagagaacatactaaatgaaataagccaggcatagaaagacaaatgctgcatagtctcacttaggtgtggaatctaaaaaagtcaaattaaaaaaaaatgtcaagcagagaatagaatggtagttgccagggactctgggaagtagcaggggtgggggtggaggggaggggatgggcagaagttggtcaaaaggtacaaagtttcaggtagacaggtgtaagttctggggatctattgtacagcgtggtgactgtagttaatactgtattgtgtacttaaaaattgctcaccaaaaatgttctcaccaaaaaaatgatgtttggatatgttaaacagtttgatttaatcattttgacgtgtgtgtgtgtgtgtgtgtgtgtgtgtgtgtgtatacatcaaaacatcacattatataccatatacaattaatatatacaatttttgtcaaagaaaaaatgcacatgaccaatatgataaaagtttagtctcactagtaataaaaatcaaaattaaatgaaataaaaatttctttccccaaatcgcaaaagagaaagaaaggtaatactaaaacacagtcacggtgtagtgagagggctgctctcacacaggactgatgagaataaaattggagagcagtgtggtaatatacatattaaacaatgtatataccctctcattttagaaattctatattagaaatccatcctaagaaaataaccagggatgtgatcaaaattttgaatgcagcagcacagtattatttataatagttataaataagaaacaacctgaatgtccagcaacaggcaaaaatgataaataaattgtggcatatttaagctggtggctcatgcctgtaatcccagcactttgggaggctgaggcaggaggatctcttgaggccaggagtttgaaacctgtctgggcaacataacgagacccagtctctacaacatattttttaaaattaggtggggcatggtaactcatgcctgtaatcccagcactttgggaggctgaggtgagcagatcacctgaggtgaggagtttgaaactagcctggccaacatggtgtaacaccatctctacaaaaaatacaaaaattagccagggtggggtgcgttcctgtagtcccagctactcggcagactgaggtaggagaatcacttgaacccgggattcggaggttgcattgagctgatatcatgccactgcactccagcctgggtgagaccctgtctcaaaaaaaaaaaaaaaagaaaaagaaaaaattagctgggcgtggtgctgtacgcctgtagtcccagctattccggaagctgaagcggggggattgcttgagcccaggaatttaaggctgcagtgagctatgattgtgccactccgctccagcctgagtgagaaagcaagactctgtctcttaaaaaaaaaaaagtgatatatttttaaaatagagtatattacttatatagacatcaaaaacaatattttcaagggatatttaaaaacataggatcatgacaaaatgtaaagttcaaaggtaagatggagaatggagaactgtggggaactgtataatctgacaattcgtagttgcatacatctttctgtgtgctggtgctgttagaacactttgtacgcatcacctcatttaagttcagcatccctaggtggcagatactattattatattccagttttgtttcacgttgtatatgcggtgtgagccccaatatgggatgtgtgtgtgcacatgtgcagtatttggaaagttctatgaaatattattagtggttatctctgggaggtgatttttattccttttccagtatgttctcaagcatttgctgcaagcagtcttttgcggggccagggttgagaggcagcagcagtttccctaaattacagatagagggaggtaggtggttatgcttggccagatctctgtctaggggtagaggagtgcctgtgtgtgggtagggacaccggcggggggctttgccaaacacagtggaactgtcacgctggtctctcttctcaactctttcactcacctgagaaaagggtgtctatggaccatgcacacttctgtggggaattttacaagatgtgaatcatcagtgatgaagatgctttcatttaaaaagaattggagtacctgagattagagataacttctacccttttaaaatatttttaaaaatttctttgcactgattttttttcttcgtttttatgagttgttttcatttgggtgggataactcaatctacaggagaatattaagactttttaaattttaaaaaatatactttcaaatacttaatacattttgtgttaaatgacagccagcagatattgactgaattgggctagatgcttcagggatctcccttccatttaagactctccgagaggccattcctgactgcaggtcactgtattatttttaattttaaaatttttacttacttattttatttaattttattttttgagacagagtctcactctgtcgcccaggttggagtgcagtggcacaatctcagctcactgcaacctccacctcccgggctcaagcgattctcctgcctcagcctcctgactagctggggttacaggtgcaggccaccacaccccgttaatttttgtatatttagtggagtcagggattcgccatgttggccaggctagtctcaaactcctgacctcaagcgatccttccacctcagcctcccaaaatgctgggattacaggcctgagccaccccactcggcctactttattaatccacttgcagaaacaggatatacacaaaaacgtttcaaggctgtaagtgccactgcatggcaccaatggtaaacgttttacaaatttgagtcaggaacaatcattagtgtcactagcaacaaaaatcaaaattaaatgaaataaaaaatttctttccccaaatggcaaaggagaaagaaaggtaatactaacacgcagtcagggtgtagtgagagggccgctctcacacaggactggtaagtacagagccatggagtaagcaggtcttgagctgacactggagaggatccttttttttttttatttttatttttttagagtcagggtcttgcttttttacccaggctggagtacagtggtgccatcatagctcactgcagcttcaaactcctgggctcaagagatcctcctgcctcagcatccccagtagcagggaccacaagtgagaggatcctttagtgttgtcaaggagaaggaacagaggtgtggatgggtgggcacagacacaggagcacagctgaagcagaggattacaaagggtggagcctgatgtaaagaaacctaataggtgacagagcatggaggctcttgaataccaggctggaaactgcattaggaacggtgctcataattgcagaaaattttacatggcctagatagtcatcaaaggatgatgtacaaacaactatggcatatttatacaatgtgccgacaggatgcactgaacattttgaacaacaaagagacttgataatggcgaggttttgaggaggtgaatcaggatgcaaaaaaagcaaacaactaataaagttgattgatgacaaacactatcaaaaggcagccaggagaaaagctactggttacctccagggagctggtgagggaggctgggtgggaggatctacccttctgaattctgagggcacctccagtgtggccctcagaaagcaggagcttccaggctagaatcagatcccgacatccctgttaattccacggattccacaccgagtcagatttatgatttactatagggttttaaaaaccaaattgcagggatgctagcctatcacagcttatctcagacattgtccactaaggtatacagagtgctgcctgttcctttggtaccctaatcaggaaaccccatcagatctgctccttcctatggggtagtgagtaacacgaaggcttaccatctcacacagataactggtcataggtccagcagaagtttaaaacagaaaatgaggaaagccatgtgattaactgctgccagactgtttgtgttacaaacagcagttccttaggcattgcctgggacatgcaataatttctgttacacaatctgtggtagttaaaatgctgcacgatgaaagctatctgatttggattcattattaggtgagccatctcgtctgcaatttggttccaccattttcatttaacaaatgtaaaaaagtttattaagctcttacaaagttatgctgggcaaatatgcaaaagtccagatcacctaccgcaggaactaatctagcctcctctctgggcaccctgttgtttggggctgggcagttctttcctgtgtagaaccatctagggctgaataggtcattctgacacctgggcacctctgcctgctcgtaaatgggacaatcagaaagggcccttatgtttccaaactttctttaaagtagctgttctgaaaacatggtccagggacccctgattgtccctgagacctttgaggggatcttcaaggttaaaattaatgtcataataatactaatatgttatctgtcttttttcactctcactttctcacacgtgaacagtggcattttccaggtgacagagtgtgtgataatgaacctaactgaatgcagaagcaaacatgagaacctagttttttcaatcaaaccagacgtgaaagagatttgcaaaaatgaaaaaacaatgctatcctcctcacaatatttttgttttagaaaataaagttatttttcctagaaatgtttttgagtttatcagtcataggtttattattataattaaaaaatgaaatatacatacacagacatattttttaaagttctcagttttaatctctttttttttttttttttttttgagacggagtctcgctctgtcgcccaggttggagtgcagtggtgcgatctcagctcactgcaagctccgcctccctggttcgcgccattctcctgcctcagcctcccgagtagctgggactacaggcacccgccaccgcgcccggctaattttttgtatttttagtagagacggtgtttcaccatgttagccaggatggtctcgatctcctgacctcgtgatctgcccacctcggcctcccaaagtgctgggattacaggcgtgaaccaccacgcccggtctcagttttaatttctaatacagtaagtattgatcagtgtgccccacattagtaaaagctcttggggtcctcagtacttctttttaagagttgtcaaggagtcctgtgaccaaaaataggagagccactgccctagaaggacagccccagcccgggtcaggaacaactgggacagaacctactgctcctagtggattgtaatatgataggatttaaccttcaaggtttcaactcttggcaagagtccatgaggggccatggtttgtcctgagcattgcttactgttaacaggagcaagttccttaggctggtgagccaagccagcctgacgctggccatggacatcttagtgggctgcttgttctagtgtgggttttcattttatgggaaatgtcatctgctctaaggctcttctcatttggggaaatcacaagttctcagaatgtttgtctctcttggttggggcctctataattaaattataaaacagaggtaatggttaagtaatgcaagatttgacagaaaccacagaggatttagggtttaatttgagtgaggcaaaggggggatgaagatgagcggtcctggagacaagaaaaagattggatgaagctgggcacggtggctcacgcctgtaatcccagtactttgggaggccaaggtgggcagatcacttgaggccaggagtttgagaccagcctggctaacataatgcaaccccgtctctactaaaaatacaaaaattagccaggcgtgttggtgtgtgcctgtagtcacagctacttgggaggctgaggcatgagaatcgcttgaatccgggaggcagaggttgcagtgagcagagatcatgccactgcactccagcctaggcaacagggtgagactctgtcttctttttttttgagacggagtctgtcgcccaggctggagtgcagtggcatgatctctgctcactgcaagctccgcctcccagcttcaagcgagtctcctgcctcagcctcccgagtagctgggattacaggcatgtgccaccacacccagctaatttttatatttttagtagagacggggtttcaccatgttggtcaggctggtctcaaactcctgacctcgtgatctgcccgccgcggcctcccaaagtgctgggattacaggtgtgagccaccatacctggctgagactctgtctttaaaaaaaaaagagagagagggagagaaagattggatgaaacaacagagtggggaggacctgtgagcttggtagcttggtgaaggcagggctttattgggggccttagaggggatccaataaaggttcccagtcatggtagtgacctaaagaaaatagcattttaacatctttcatttcataatagacagtcacagtttacaagaccctttccatacattccttatgacatccatactacagcccagaggcaagttgtgcactctctcctctcacaaatacaaaaactcagcctctagaggccagcgacctgctcagggtgatgtgcaattcagggatgacagagtcgaggctcccagcccagtggttatccctcacaggcacgttgcctgtcagtgtgcagtataaaactttgtacaagaaatcaagttgcattagtcagtcggattccccaaatgatcacattgtagatggtgtatgctgtgggcagagcaagggctgctgtttcttgggcaaaacaatcagtccccctcccccccaaaataaatgaatgccaatggtgtgactttattttatttattttatttttattattatttgtgagacagagtctcactctttcacccaggctggagtgcaatggcatggtctcggctcactgcaacctctgcctcctgggttcaagcgattctcccgcctcaccctcccgagtagctgggactacaagtgcatgccactgcacccggctaatttttgtattttttttaagtagagacagggtttcactatgttggtcaggctggtcttgaactcctgacctcatgatccacctgcctcagcctcccaaagtgctgggattacaggcatgagccaccgcgcccagcaatgtgactttataattacagaatgtaggactcagctcccactattgttatgactcaatattctcttagataatgtttggggcactagcttacaggcagcattgcccggtggttaatgttgtagctttgcaggcagactgaccatattaaaattcgatcacaccatttgctaagcctgtggactcgggcacgcttctttctctgcgttagtttcctcctctgtaaaacacggatgatgctataaacacacccaagtcctagaattgttatatgagttagaaaagataggcaaatacaactctcacaagacagcctggcctccagtaagtgccactgagtgtttgctcttattgtacagtggctccaagtgcttctgtcttggattatttctgaccaggtggctatgtctcctagtaacttaccaatcctgttgagtcttaataagcacgtctttgatgcctacagtgcgactgaatttccaggcctcattactggagacacaatcatcctatatgcttttttccatttgtttttaataaagtggtacatgtgtatggcaccagatcaaacagtacagaacaagttacaatggaagagaatggcctcccagctttcctgaaatcctcaactcagagacaacttttttttttctgacggtttctttatacagccctttttgtggttaccttcctaactctagaaaaactattcttacctctgtttatttacttagaaacattagacgttacctttcaactcctcagtatgaagctttagttttcagcaccccaggccaccaccctctttccaggacttactacttatactggtggtaggtggaattttaaaattcatcagcattcttttgtgattctctgtgtgttccagttttacagcaacccgtacttgttgcatgagtacagtagaactgggaggctcataacttagcctgcaggacttttcacttaaagcctggccctcagggtgatgtcacccacctcattgtgcctggctcaggagtttagtccctcagttgcctggttgtatagtttggatgttcagcacctccaaatctcacattgaaatgtgatctccaatgttggatgtggggcctggtgggaggtgtctgggtcatcaggtgggtccctcttgaatggcttggtgccttccccatcgtaacgagtgagttcttgctctggcagttcacacaagagctggctttttaaaggagcctggcaccttccgctctttctcttgctcttcctcttcccttcctttgtcactaaaagcttcctgagccctcaccagaagcggtgcagatgctggtgccatgcttggacctcctgtagaactgtgagccaaataaactctttcctataaattacccagtttcaggtattcctttatacaatgcaaaacagactcacacatctggtaaaccccagttgtttgcttctaggtaagacgggaggagtggggagctggtgagggtttccactgcattgtctattttcaggcaaggtgtctccactgagtaggcttcacattcagagctctgggtaaggtgggcaggaagagggttgcaggctgcccaaaggagggagagaagaaggctgaatccttcagtgacaacctgtgaaccagagtcttagctctctttgaatattttgttcagtatctttgggttttgttttattttgcctaggggtaaatgctgactgcctgttctctggacaggaatggagaagatggtgctagcagggttgctgttcatatgtagacattcatgcagtcactctcttttcagcacacttcttacttctgccctgggttcagttgctgactctgagcccagaaaccttctagggttctgttaggtagattggcttccaccgtctttgcgacaaccacagaaaattctagactgttttctcttcgggcttcattagtcaacttgcttcagtctgtcttgcatcttctaaatatttatagatctctctcttttgttggagtggcagaaaatgctagttgaccacccaatattcaaattatcctgcctccttaataacagaatatcattggatgtggtgggtaaataatataccctaactttccttgcagagaggggtggccaatgagatggaaatgaaagtcattgggaaagactcccaagacatctctttaaacaagacagactgaagcaagttgactaatgaagcccaaagctagcagttgtttttgtttatctttgcctctttcttcttcttcctgtggggacaaagggcagtgatatctggagctgcagcagccattttggcataatgttggaaaagccaagagactctcagagaccgcagctccagcagttttttattttttccaaatatttgctccactgcaggaggatgagatattcgtgtttgttgccttgtgactgtaggaggactgcacttccctgccttgttgtcaagtttccccatgtggtctgctttggccagtaaaacatgagtgggagaagcttggtgaaccattgcatgtctaccagcttttttgctctcttccctttggcattagaaaggcatgtccaggatggagttgttccttcagcctagattgggttatgagaagctagctgggggagtccagtaacatataaagcgagttagaaataaaactttgttgttgtaagctatatatatatatatatatatatatatatatatatatatatatataatatgtatgtaatatataaatacatattatactttaagttctagggtacatttgcacaatgtgcaggtttattacataggtatacatgtgccatgttggtttgctgcacccatcaactgctcatttacattaggtatttctcctaatgctatccctccccagccccccacccctcaacaagccctagtgtgtgatgttccccttcctgtgtccaagtgttctcattgttcaattcccacctatgagtgagaacatgtggtgtttggttttctgtccttgtgatagtttgctgagaataatggtttccagcttcattcgtgtccctgcaaaggacatgaactcatccttttttatggctgcatggtattccatggtgtatatgtgccacattttcttaatctagtctatcattgatggacatttgggttggttccaagtatttgctattgtgaatagtgccgcaataaacatatgtgtgcatgtgtctttatagtagcatgatttataattctttggatatatacccagtaatgggatcactgggttaagtggtatttcaagttctagatccttgaggagtcgccacactgtcttccacagtggttgaactaatttacactcccaccatcagtgtaaaagcattcctattcctatgtctccacatcctctccagaatctgttgtttcctgactttttaatgattgccattctaattggcctgagatggtacctcattatggttttgatttgcatttctctgatgaccagtgatgatgagcattttttcatgtgtctgttggctgcataaatgtcttcttttgagtagtgtctgttcatattgtttgcccattttttgatggggttgtttgttttttttcttgtaaatttgtttcagttctttgtagattctggatattagccctttgtcagatgggtaggttgcaaaaattatctcccattctgtaggttgcctgttcactctgatgatagtttcttttgctgtgcagaagctctttagtttaattagatcccatttatctattttggcttttgttgccattgcttttggtgttttagacatgaagtccttgcccatacctatgtcctgaatggtatcgcctaggttttcttctagggtttttatggtttttaggtctaacatttaagtctttaatccatcttgaattaatttttgtataaggtgtaaggatggtttccagtttcagctttctacatatggctggccagttttcccagcaccatttattaaatagggaatcgtttccccatttcttgagctacagatattttgagtttggttaccacagtattatctagtggaagttgacttatacagtatgtaataggataaatataggtgtgtaacagaatattaagtgttcgtgtttcaaagctgaggggaaaatgttaaaagtgttcacacactctaaaaagagattagctaaaactgcttcattaaccacactttggggaaaccagttctgagattcttctccattactctgacaggttggaccctctggggagcagatctcaagatcaagttatgagtgcaagaggtgtgttgggaagcgatggttgtaaaagaatcctgcagtagcaccaggcacaagtctgtccagggagaggaggacttctactctctaccagcatctctcctaagtccccttaggggacgggggcaaggaagtgctgggaagggcagggcatggttcctggctaggactccacccccctggggcctgtacccacggacctaggtgaagacaggcactcctgccttctcgcccaacggttgcgtttcccaagatcatcctggcctgccacgcccccatctacctattaaactcccccaccttccccaaaccctagcaggcagacacacatcggtggaagaagacaggagcggctggacattgaaaggacgtcgagaggagcacacctgcacaccatcgaccagcggaacgaggcagagtgtggctggagcagtcggagggaagcctgggccgctgactccaggggaaaaccatctcctttctggctcccccctctgctgggagatactttcactgaataaaaccttgcactcattctccaagcccacctgtgatccgattcttcctgtacaccaaggcaagaacctgggatacagaaagccctctgtccttgtgataaggtagagggtctaactgagctggttaacacaagctgcctatagacagcgaaactgaaagagcacacaatagcacacactcattggggcttcaggagctgtaaatatccacccctagacgctgccatggggcgggagccccacagcctgcccgtctagaggtttgagcagcgggacactgaagaagagagccacaccctcatcgcacgtcctgcgagggagacaagggaacttttccggtttcacttctgcttggcttgagctggcactgaagcacccttttccctcctcactgagggagcagaggggaaaagcggtagaactaacaggctaacaatgctcctccgaaaatatatcgtatttttggatccctagagataggtgatcacggcagccgcggagtgcatttgggtctcctttcaagaaagaacttgctgctcagcgttgaagaatgcagttggccaacagcctccagctgctctgtcttcagcatctgccatggcatctgagctgaggtcatgttcttcctgggaggtccccagcagaaggatcacgtggaagctccacaagctccacagatgttccaggagaggaataggcagcatttggaagacatatcctgccataacagagggcatttgctagtagagacaacaaacagcaacagccaagtaaacaaacacacaagcacaaagcactttctcccatttcccctcattgatcctgtccgggtagaagctggggaggaagtagaatagggtgaggcggggtggggctggggggcctacaccttcttccttcccccgcaggtcctgtccctgggccaggcttgaactaggggaatgggaaaagctgtgaagtgaatgagaattaggagtttttatttagactggacttgaatttttttttttttttttttttttttgagacagagcctcgctctgtcacccaggctggagtcccgtggcgccatcttggctcactacagcctctgcctcccgggttcaagcgatcctcccaccacagtctcctgagtagccgggattacaggtgcctgccaccatgcccagctatttttttttttttttgtatttttagtagagacagggcgtcaccgtgttggccaggctggtctcgaactcctggcctcaagtgatctgtccgcctcggcctccccaagtgctaggattataggagtgagccaccacgcctggcctggacttgaatttttaattcctaaaaatgaactaccagttaaaatttaaaaatgaccaaaaaagctatgggatatgctgatgttttgctttggggataaggaaaagatatctggttgagcggcattgaaaacagtgtagggagagaaaaactcattcctggctcacccttttgagtcccactatctcaataatctgatgttatatgacacacacacacacacacggaggaatcctggaagactccatatcaaggtggtgatgaaggtgaccagtgggtgataggattataggtgtgtgtttatttatttattttaattacctttttttagagacagggtctctgtcatccaggctgcagtgcagtggtgtgatcatggctcactgcagtcttgcactccagggctcaatcctcctgcctcagtctcctgagtagctggagctgcagtcatgcaccaacgtgcccaactaatttactttattttattttttattttttgttaagatggaatctcactttattgcctaggctggtcttaaactcctggtttcaagcattcctcctacctcagcctctcaaagtgctggaattactgcacttggccctattatatttttaaaaaatttcaatagttttaggggtaaaagtggctttggttacatagatgaattgtatagtgatgaagtctggatttttagtgtacccatcacccaaatagtgtacattgtacccaatgagtagtttttcattcctcacccccacactgtccccacttctgagtctcctgatgtccattatagcaccctgcttttgcgcacttagagcttacctcccacttagaagtgagaacatgtggtagttggttttcccttcctgagttacttcacttaggtcagtggcctccaatttcatctgagttgctgcacataacatgatttcattctttttttgactgagtagtagtccatctctctctctcacacacacacatacacacacacacacacacacacacacacacacatttatccactcatccattgatgggcacttaggttgcttctatatctttgcaattgtgaattgtgctccaataaacatacatgtgcaagtgctgttttttctcccttttatccttcttttcttccctatgcttccataggtactgagaaagagtcttttttatataattatttcttttcctttgggaagatacccagtagtgggatggcttgatccaatggtagatctgtttttagttctttgagaaatctccatattatctccatattgttttccatagagattgtactaatttacattcccaccaacaatgtatgtgttccattttcactgcatcggcaccaacaacggttgttttttgactttttaataatggccattctggctggggtaaggtggtatctcactgtggttttaacttgtatttccctgataattagtgatgttgagcatttaagaaatatatttgttggccatttgtatatcttcttttaagaaatatctcttgaagttgtttgcccactttttaatgtgattatttgtttttttttcttgctgatttgtttgagttccttgtagcttctgaatattagtcctttgtcagaggtatagtttgcaaatactttctcccattctgtaggttgtctctttactctgttggttatttcttttgctatgcagaagctttttagaataattaggtcccatttacttatttctgttattttgttgcatttgtttttggggtgttagtcacaaattctttgcctagaccaatgtccagaagagtttttcctaggttttcttctagaatttttatggtttcaggtcttagatttatgtctttaatccatcttgaattaatttttgtatatggtgagagataggaacccggtttcattcttttacactacatgtggctatccaattttcccagcactgtttattgaataggatttcctttccccagtgtatgtttttgtttgtttggctgaagatcagttggttgtaggtatttggttttatttctgggttctctatgctattctacttttataccggttccatgctgttttgattacaatagcctcgtagtataatttgaagttgggtaatgtgatgcctccagatttgctctttttttgcttaggattgctttggctatttggacccctctttggtctcatataaattttaggattggtttttctaattctgtgaaaaatgacattggtattttgataagggttgcactgaatctgtggattgctttgggtagtatagtcatttttacaatattgattcttctaatccataagcatggtatgtttctccatttgcttgtgtcatctattatttctttcattagtgttttgtaattctccttgtaggggtctttcacctccttggttaagtatattcctatgtattttatttttattttttgcagctattgtaaatgggattgagttcttgatttgattttgagcttggccatcattggtgtatagcagtgctagtgatttgtgtacattgattttgtaacctaacactactaaattcacttatcaaatctgggagatttttgaggattccttaggattttctaggtatgagatcatatcattggtagaggtagtttgagtttctcttttccagtttggatgccctttatttctttctcttgcctgattgctctgactagggcttctagtactatgttgaatagaaatggtgaaaagtgggcatccttgtctcattctaatttttagggggaaatgctttcaacttttccccattcattttgatgttggctgtgagtttgtcatagatgattcttactattttgagatatattcatttgatgcctagtttgttgagggattttatcataaaaggaggctggattttattgaatgctttttctgcatctattaaaatgattacgtttttcatttttaattctgtttatgtcatgaatcacatttattgacttatgtttatttgttgcttacatctactttctaattttactataataaacatgtataattttgttatcagaaaagtaaatgtaaaagtgagttttaattttaaaacttgggcctaagtcttcctgcctcccaagcccattcccttcctgatatctggggcttccctcctcaagcctgctctgcaggataaggggatacagtccacatgcctgctgctggtttggcccatgataacctccatgggcaatgtctgagcctctgctgttgagttttgctttacacactcctggcaaggaaaggatggccaacatggcttggacatgggttgctgataattggtgatgtctcatgactggttctgcctggagggcttgctgtaagtccctgataggaggaacatggacctgcacaagagcagaacttatctgacactgaagaggacacttcaagaacagattatcaaagtctagctcagggagaaatatactttagagcagaatgaggaatggcgaggcagctgagcttagacacaagcagaaggaaatccatggtgagggcacaggcaaggaaaggggctgagagagcattagtgggggcagtcaggggcagtggtcaggatgctcggatgccagcgtgaacaatcgcatcaagattaaacaccatgaggatcgttagacttcctgtcatatgtctccaggtggtgctccaaatatcctaaaccagatgacagcacccctccaccctctgctgtataagcacatctgctctcctataatcattcccacatagcaatttatcatttttattgatttttcttcatttaatacacgtataagtgtgtcttttatttttaaaaatttgcattcctttaattgctttggagattgtgcatttttctctctgttgatttactctgccaataaacatgtaatcctaccataagcatgttttacttgtgtaatcaaccaaaataaaaaatttaaaaaggaatcactgactatgaattagacatgtggataggcaccagggttgcagacatggcccacgttcttgcattaacttgcactgtggctggggcattggatgggtacattaaaaggattaaagtaatataaggcagtatttattaagtgttgagtgagcactacagaacccaagtgctgagggagtttcatgcaggaagagatcaagagtaacacagagaagaagaatagatcaatttagcgcattcatttaaaaattcaccttttgcataaggggatgtgtcttttgtggggaggaggggagttccgattggcagtttgttctcagggagcttgaagaagagatcttggagaggagacgcagagaaaacaaatgaagaaaatgtcaaaatggaaggggttggcccggctatgcataccttagttagcttaggtagagtctaaacttttacaagtggtttcaataggtgtgtttggtctgggttctttgggaggtatcataggagaatgaaggcagggaggacgcttccagcaccaaaattcaaagggaaatgtattttacatgcatagcattgttttactctctttccatttggagcatatcttaaaaattccatttggagcatatcttaaaaaacccatttctctgacaatggttctaaaagggggaaacatcctttgcaacagaatcattcattctctcattcatcaaccactgattgtgtactaagtgtcagacctgatctccatcctgcctggtatggcactagcttctgtcttgagacaagcattgtgataaaccatgaccaaaaaaagggcagttttataaacacaagtctgccaggctttcagcaattctaaatttccttttgcaagtcaggctggagttaatggctctttcctgcagcggcggagatgacagggctctcccacagtgctgagcaggcagtttgaaagccccacttcctgtctctgcatgggcgagtgtccactggaagccactgagaggaaggagggaaacctcagaaaccggcccctgcctggctgcttcaccctagaaagcccaggcagaggagggaaaggtgaagtgctgaaaaagaataaaaaagggggaacatgaaaaagagcaagagcaggaaggaggcagggacgggaaaggaggggaagcacggaaacagccaatgtcaaggagaagaaaagatggctggtggaaaggagcttccaggaattgggacacagccctgtcttattgcaaaagatggaaaccctgaaggagaacaggaaggaaaaagaaaacaagtccgtctgagctggcagggtccactttctcattctacagatgaggaaacagaggcacagagaggaagtggcttgcccaagggggcagattcttgaaaggatcatctgcactctctctcccttaatgcattcttacctcttctttactcgtgagtcagtcctgaaggacaagctgcctgaagtcccacacagatgggcctggggcaagcatcaaacatcctgggggccctgggtgaggtttgcttttaaattccaggtcagggaaaggaaggtctttaagttgtctgctctaagcttagtaatccccctcagagttatgggtgcggtgtctggggtagccgttgcgtctctgggcaaataccctggagaatgcagtgttggttgtctgagctggggacagagtgacagcatagttgcatgcagagctggaggctcctgcagctgtacaggtaaggtgctgaaattctccaccaacccttcctctttgcccccagcaccacgaagataaccctctttgaatatgtggaagtctgttctccaaactttctaacattctcatgtcagtcttaatagattcagctcagttactgcctcctccaggaagtcctccttgtctgcaaatcggctgcccaccatgccggctcactcatagttttaactctgtatctttctaatatgccttagcccactctgtcaggattccagtcagcttccttctcctagactaggagttgcctcaggccaggaggaccagccttgttcatatctgtaccctgcaaacctgtcaatgcccaaacctgctcagtgctttggagtatggaaccagccgtcaatgcaggaatgttacactctaagagttcccaaaggtagagagatgagggattggtgctggaagtgggaggttattctaaggatgggtatggcaggaaacacaattatagttcagggagtggagtgtccaggagtgggaggagaggaactgggagaaagagcagagagtgaaagtgagagcgggcacaaagaaagggaaaaagagtcagggatcaaccaaagtgcatgcttccttttcagccctgccaggatgtgcagggcggctgctgtggacgcgtcaaggctcagcctcaaacatgtcttcttccttgacttttgtctatcattctaaagctaggtcatttaaaaagttcttttgttttctttccaccgatactctgatttctgacattcgccaaaaagaggtcaagaccctggcataccgccctactaagattaaaataaatattatccattgaaactgttattttttccttaactgttatttgtagagttaaagattcccatgatcgcgctggctctaacatcatttttggctcttttgagatcaaatttgcaatttgatgcaaaaatagctgtgacgcatatgtgtctgtatgtgtgtggttaggagattttttatcattacatcttcttttgccctgcctttctgcctttctgtccttttaatttgcgggcttttggcaaccacagcacgggtctggtttcctaggagtttcttttgtaggatcaaaccgctagttggctcttggccctgtgatagggccctgggctaacttattgggaaaatgttgctgtaacccctgcccagaggtgcctgtgacatgggccgccatcttctcctcttcccttggcttcagccccacctagaaacctgaacaaacattttccttgacatttcataaagtgtcagtggctcctcatttagcaaaatacatcccagggaagttcaaaagtgaaaaaaggccgtaacttcttcttcttctcagggacctacagaaaatatgtggcacctcggcagcctggcctgcagcactcccctccccatcggtgagtcctgctacagtgggtccaggtgtctggacgcccggcacgcacggctctctgcagacctctggacagtaccatgggagccgcacagtccctgcctgttctgtccggcagttcttgtttcccagcaccctgtctcaggtgagaggttccctcttctgctgggcttctcctccctgctgtgaaccccaaatatctgaggcaggtcaatttaggaaccttattttgccaaagttgaggatgtacccatgacacggcctcaggaggtcctgaagacaagtgcccgaggtgatcgcggcacagcttggttttatacatttatacagacatcagtcaatatatgtaagataaacattggttcggtcccgaaaggccggacaactccaagtggagagggggcttccagttcacaggtagataagagacaaaatgttgcattcttttgagtttctgattagcttttccaaaggaggcaatcagatatgcatttatctcagtgagcagaggggtgacttggaatggaatggaaggcagttctcagtttaaattttccctttagcttagtgattttggggtcccaagatttattttccattcactctgcagacaggggcttctgtgcatccagggagcccctcctcacagaaggaagcaggccattaatgagacccaatccagcttcaaccacctggtaacaattaggacatcacttctctgagcaagagctcctgcctgtccatgagttatcaagacattccaattgttcctccacatctttgacatgaagacttgagggggtcagattttccagggggcttgatggcatgttctcttcactgttccctgccctggtcatccaagtgacccttggcagggaagaggccccgagttgcagaatctctgttctcacaagccattgccaacccggagagtggctttgccactattcctagcatgttgttggctatttcaggaatgggagtatttgacttttccctttgcagtgattgctgcaaggagaggaattgagagactcaagtccctgagataaatatttatcaactattactgaaagggagtatgtcaaagaaaaaatgtggagaaacttcagcttgaacacatagtttaaatccagcttgggtgtactccagtgggcatggatgtattactgttttgcagtgcattcttctatgatcaatacacagaagcaaacaggccacgtgggtaaacagtaattttcatttaccagggtgaatatggaagtcctcttgtttccatgtcatgatgaaggaaagcaaggaccatcttttgccaaggaacagtggctgtgggggaactgaggagatggaaggacaaggcagtcaaaagctttggaacaactctttttttgagatggagttttgctcttgttgtccaggctggagtgcaatggcacgacctcggctcaccacaaccgctgcctcccaggttcaagtgattctcctgcctcagcctcccgagtagctgggattgcaggtatgctccaccatgcctggctaattttgtatttttaatagagacgggatttctccacgttggtcagctggtcttgaactcccgacctcaggtgatccacctgcctcggcctcccaaagtgctgggattacaggcatgagccaccatacccggcccttttttggaataattttataggttttcaaactattacacttacctttttatataagagacaggacatagtcactgaacaatcactccagattttaagtaagtccaggatgggatgacaatggaacaaccatgaaatgaaaggaagaatgtgtcactggtatgtccacacgtctccaaatctctcacctctgtcagctgcaaacagagcctgaaataaatgtttcctctgtgcacagcctccacaacttcctccctccacgtttctcactcactcctctccagcacttctctccgggttctgcttacaaacttgaaaccggctatgcaaaaattataactgtggaaattatgacagtgaaagagatcagacctaaccgactccatcttgcttctaacctttaagctgtccttgttcatttttgggctgaactaactttgggaaggaattcagttcatggtagaactctgaaacaaaattgataatagccctttcctgaaaagacccccttcttgcctggggacaagtctgccattgtaggactaacaaattaactacaagattagaaattaaggtttagggttcatgcagcctccagttccaagagtctaaacctccccaaattgctcctggggataacatcactgttgtaaaagctaagaccagtgcttgagatattttgtagaccctgctctggatggatcagctgacaccatccagactggtaatttggctcaaccagctctgccatcccacccaggaacagaaaaatactcacttcatcaccccatgagtccatctctaacctgaccaatcagcactccctacttcccaggcccctactcgccaaatctgcctttggaggcagataacaacttatctttaaaaactctgatccctgaatgctcaggagactgatttgagtaataataaaactccggctctgcatgaattactccttttccattgcaattctcttgtcttgataaattggttctgtctaggcagccagcaaggcgaaccctttgggcggttacaaactcatcctctgtggaagagtaggagttcatggagaaattggttgcaaattacaaaattttattgtaaggtcaacttgtcccagtgtccgtctgtgcagcgaagggcccctgcatggtttagtgattgcaagttgagcctctagggtcaggttgtctaggtttccatcccagctcattcacttattatctgtgtgttcttgagcaagctccttaatcaattgaggctttgtccttctgtttgtataatgatgagaataataacctccacaataacctcatcataaggttgttgtgaagatggatcagataatatatatgtagagtgcttataacagtgcctggcacataaaaaatgctcaaaaatcttaagtgttattaataataaactgacatatatttcttgagcagggtggtggtaaatgggtgttctttttattaagctttaaagtgtgcatagatcatattaattctttttatgcatatgatatattgcacatgcatgaaaatacatgcattaaaaataaatgagcatttatgagatttagtttagcagtcacatgtcccaggattacaagccagcaataatgggttggaaaacattccaacccattccaaccattggaaaacattccaacccatcactggacccatgtgccaaacaatggaaccgcccacaggttctcattcttggttaaaaaaatatgattattacgggaataatactgattccctaagaattaatatctgagcaagtttcttttttttcctgtcttcttggaagatcagcaggttctagattcaatggagtcactaggattgagccaccagtatacgccagtcctctccagaacggccacctggtggtgggcactaaggcagtctcagatgaggactgattgacttttgtgtgaactcaaactgccaaagtccctccctcaccttgcaaacttcaaagcacaactttcaaagcactactttctttcttggctctcaattctctgcctagaaaaagggaggtgttggcaaggatgtttgtttagttctgggcatcagtcaatggtacccagatcttgctgaacagaaaagacacagatttgtttctctgaggcagttggtagtgcttattgcttattgctctcaggggcttctgcagcagtagaagggccctcttcccctgccatgccacactgagaggagcatccttggagtcatggttggaatctgtttttgttatgctagtcctcttccgcatgctagctgttgcattgcagggatatgtgtacctgtttatcttctccactaggctctaagaagccaggtttcttaaaggaaggaagctgatcttgtttatcttgaagtcctcacagtgacattgctcagtcaatgttgagtgtatgaatgaataaacgggaaccatcacgaaaaagccgaaaatacagtggaaagactggatcataaaatcttctaagcaaattttttttcctcttacactccatttccaaatagataaagtattttttaaaatcctatcagaatattctaacacactgagttgacagaatagagatttttaaatgcagtgtcatttggccagccatttgtgagaatttataaatgtttcagtaggttgaaaacactataaaagcaaggactatgttcatacccaacagctggcacttagtatgaatgctaaatgaaacattctcttctctttcaagagtcagtccaaccagtgaccctgacaagaaggaaggcacatttaactcaatttaatgaactcttatagagcatctccttctccaagtgctttgctaaggatggggtaaaaacatgaataagtcttggattctgtccttcaggaattttcagtctttggaggcagatacatttgcacccaactattatcctaggcagagtgtgataagtacgataatagcagtaaaagctctaagttaggcaggagaggaggagctcgttaaagcttatggggcctgggaggctttcggcggagtaaactccagggggacagctaggcatctggctgctggaattgggaggaggatcattttaagtggctacaactctgggtgcacaggactagagggtgagggccaagatgggaaattgtggcagccatcttccacactgggcgcccgccgacccttgcttcctggtattcatattattgtgtagtgtcccccaacattgtatcagggttggcctgtgtgaccaattgcatatggtgggaatgatggtgtgtgacttctaagaccagttcatagaagatgtggccaattcccttactgtctttttttttggcaggggagtgccgagtttcacccttgtcgcccaggctggagtgcaatggtgcgatctctgctcactgcaacctctgcctcccaggttcaagtgattctcctgcctcagcctcccaactagctgtgattacaggtatgcgccaccatgcctggctaattttgtatttttagtagagacggggtgagatcaatgaggcagtcaattggccagcctggttttgaactcctgacctcaggtgatccacccgcctcggcctcccaaagtgctgggattacaggcatgcgccaaccgcgcctggcccttactgtcctttggatcagctgctctggggctaggtcaatccttcatgtgactgcagccccagccaacatctggactgaaacccatgagacaccctgagccaaaaaagcccagctaagacttcctgcatttctgacccacagaaactgagaaaagaaatgttttgttgttgctttaagccactgacttctggggtcatttgttttgcagaaatagatagcagatacagaaaagcaggctggtggaacagtgtgggaaacaccttgattttcagggagttgcactttgtttatgtgcaatggtgcactgtttttagaaagacacaaagatgataatactggtgatgggcataatacgggttgtcaagaggagtgactgaggcggggataatttaagaggccacagcagtagtgtggcaagaggtaatgagggaattgaacttggtgggaatgggtgagatcaacgaggcagtcaatatgggcagtgagtgtgaaggagctgcgaaggatgattctttggttttgagcttaggaacatgagagaaccaagatctcatttatccaaagaggaaacacagaagtgagcccctgtttgggggcagggctgggtaggaggaaaagagtggagacgtctatctccccaggaagagagccccctgcttccagatcccagtggatggcagggcactcggctcattcacagactgggctcgttgagaaacctttccctggagggcagggctgctctgtttcacagcccatatccctcatggccaagtgttcctcgagtgacagtctctgccatcaatatttttagcatgtggtctttcagagactaaagagtggcatccatctcctgaaactccttccccagctgacagctggtgacccgtggaggagggagcttcagggagcctgatgggcgagagtctgttccaatgccaatccattggaagagatgaagtcagacccgagtttgatagaaagcctacttcctcccttgtatccagctgtggagacctaccaacatcaatgcaaaccagaagctaacacccagttcatatatcccaagtggaaggaagcttctcgtggaattgtcttacatgacagtaacataaatcctgaaggtaatacttggccaggtaatgttagaaaagaacccgaacataggcattgctattatagatcctaggataggcctgagcaaaaactgtctgggattcataacatgcttcgttgcaatctgatagagggagtgagatccactccaaatggagtctgatttggggcaaagcaaagagtatggaaggaaacttgagaaagggggacagcttctcaaatggagtctggccacagctggggctggaaaagagacatgactgcgcttgcagagtggtgagaatttgctgctagaatttttaagttgtgtgttttcatttttatgataatgtaaactgagataagcatattctctgctatcccaatgagcccctcctctaggaggactaccttgccaccttatccataaatgtgtttataaattattttgatgccagctggtattttttaaaaagtggttttggactcacaaaaaaaaccatgatggatttaatacataacaaagcatttgtgtcaagtgaaggccaagtaacatcttagcgtcctgtgtgagcgaaggtgtcgtggcagttcaaacaagaatgccgatgaagctgcccaggatggccaaggccaccttggtgtgtttgaggggaattagagtttagaaaaaaaaaaaaaggcacctgacactctgaactaatgtggttacctggaattttggggttttgaagctttgcatttaatttgcagcttatggcctgaaggaaaagacaggtgaaatgcatatcctgggatgagtcacctggaggagagggctgggaaggggctgagctgcacatgctcagatcttctcccaggcttatcgacccagtgagtcaagtcttcttccaacgggatagagtgtgagagagagcagggaacagaagccagagtctctgttaaatttctcggtacatttctgttagagaatggaagtttctctatcgtaggagaccttgagagcctgggatagaaattacccctttgtcatgtattttcctcccagaaatagcatggccactgtcactgctaagctggagtatcatgagcacaatttctctcactttctatacccatgcctttctaggagattggtggctccatcaaaaaggagttaaaaagaagcagcactattttgtggaatacaatcatcaccattatcaccatcagcaccaccaaccagcaccaccattatcaaaagcattcacctggtgtctgccttacaaactgcaaactgcagtaggtatttgtaatagaatgtttcctttcccccttgggatctgcagaaaagctggagaatgttttggtatcaacacactaggttgcattgctaatcatgtgatggccccatgacagtctctgttggctggtgtagttcaggtggacgactgcaggattttgttcttggagcctcagttctgactgggcttggggtgtaaaaggtttgggagccagatgacaagagtatttgatgggtagaataatgggttcatccaaaagatcaccagaatggttattaaatagtacaaaggaggaatttactggtaataccagtttgcaaacagagaagagagtctccaatgtggactgaaagtgctctctctttgaagaggggaaggacagattgggttttatgcctcacaggactggtaccatacatattcagcaggtttttggggaaaatctatacatatttataaggtgagctgatgcctgcataatagataaacatatatgtaacatacttttcatattcattttgggactgggttttggcactaaaatttgtggaatttggctctttatgttaaaaggtgaactagaggacacaaagacggtttgtgtgcaccctctataaactggctgaaactggcttaaggtctgcaactgcttatccaaaaagaatgtttgtaaggccaggcctctgtccagtcagagttgtagtggtccaggttgtaaatcaaagtttatagctctttttgttagagagttcagctgtaggaatttagaaatttgccatgcctgccaggccctgaacctttgacccataggtaactttatttccttaaccttagggtcagtcttagttgatatggggcatctattctggtatctcagatcctatggtcaagagaaaagatcctccacaagagggtcctatgtggctgcaaaaactgctctgagctaaatccactcaaaatcactgcaggatgtcactactagaaaatagggcagggatagggatccccttcccatgctgccagaaaatgcctgatagcttacctcccccggcccttgaggctcccttggaataggcacatgcaatcccatctccacccaatagagcttgtcctagagctcagttttttcccatagttttcccacccacttgcaccagaaaatctaataaagtcatgtgattaatacaattcattttatcacgcttctgaagatttaagagagagcggtcacattggattccacagtaccgaccttctgacgattcttcatttcacctttatctatttttatttttattttatttttttttcgagacggggtctcactctgtcacccaggctggagtgcagtggggcaattacggctcactgcaacctctgccttctgtgctcaagcaatcctcccacctcagcctcccaagtagctgggatcataggtgcacatcaccaagcctggctaattttttgtatttttggtagagatggggtttcaccatgttgcccaggctggtcttgaacttctgagctcaagtgatctgcccaccatagcctcccaaagtgctgggattactcacgtgagccacctcgcctggtccctttcacctttattatctttgcctttaactctagtgcttcctccctgaatcagttaaggattgcatttggctgcattaacagaaacctgactgcagaagcttaaccaaatagggtagtttttaaagagagattgcttacatcacgcaaattgcacaaattttaagtgcatagttcaatgagttttgacaaatgtagaataacatagctatataaaaccattccatcaaaaaaattttatcaccataggaaattgtgtcctgtccctttcttgtcaatcccaactcctccccacaaggcaaccttcattctcatttctctcaccatagcttagttttacatgtttctataatacagcatcatataaatggaataatacagaatgcaatcttttgtatgaagcttcctttggctcaatgtaatgtttatgagattcatccatgttattgaatgtatcagtagtgttttcatttatatttcctagtgttctattgaataaatatactacaatttgtttatccacttatttgttgatgaacatttggaccgttggcaatttttgcctattatgcataaagctgttaaaaaacattcttgtacaagtctttcatttcatatgtttttctttttctgaggtaaataactacaagtagaattgttgggtaataaataggcatccatctaatattataagcaactgcacaacagtttttcaacgtggctgtactatttcactctcccaatagcaacgtatgtgttttccagctactccacatgctcactggcatttcctgttgccagtttaaacatttcagccattccagtggatatgaaatctctctggctataataattgtatttctctgatgactaattatgtcaagccccttttcaaatgcttatcagccacttctatactgtcctctgtgacatgtccgttcaatctttttgctcattctttaaaaacattgggttgtttgtctttttcttagtttgtcttttgcttttcatttataggagtacatatcttcggaatacaagtcctttgtcagataaatgtattgtgaataattttctcctagtttgtggtttgccttttcacattcttaatatcttttgatgagtggaaactaactttcaaattatgttcagtagattaacttgtttttgttttgttttgttttgttttttgtttttaacactgggtctcacttgttgcccaggctggagtgtagtggtgccatcatggctcactgcaacctctgcctcctggactcaagggatcctcctgcctcagcctcccaagtagctgggaccacaagcacgcaccactacacttggctacttttttatatttttggtagacacaggatttcgccatgttgctcaggctggtctggagctcctgagctcaagcgattcacccacctcagcctaccaaagtgctgggattacaggcgtgagccaccacgcccagtcgagtagatcaagttttaattttatggccagtagagatctatttcaaggctctctattttgttctgttgctctatttatctacctttatgccaattttcttctcttttgattcagatagggttataataataattattttttccagggattagatggaccagggctggtgaagttgttcaagggagtgatcaagagcctggctcctttcatccttctgttccatctcctttggctcatggattttgttttccaagtggcaagatggcgcctccacctttggtatcctattttagttcctggcagaaagaaaggaacaggctaatggccctgatgagtctacccccttttaacaggagaaaatttaaaaaacaaaaaccatgaaaccctttcccagaggcaacaaccagaattccatttatctttcattgaccagaacagaccacatggtcactggtggtggcaatggagactggggagatgaatatttttaaggtggcatattccagaagaacactgtgcactgattgcattaatgaacccattaatgtgccaaggggaggtttacctatgagcatgggcaaattagaacccactcttggagctgcaggtgagccaatcccacctaaacagtgtggatgctacaagatggggaagtaaattgattctattccataccctaacctctctccaagatgtattcttaaaatagaagagggaagacagaagaaaacatccagaatatatttttattgtcttttacttcttcagtgcattttagatcagtgcttctcaatctggcaaggggcatgcaggaggatgtgagttttatcaggaaaactacacaaccccccaaccacaatgctacccccactcctgtggaccttctttaagagagactcactattatagatggagttgatacgattttaagagaggccatatattatttgctttctgtcttgaaaaacttgtgatttttctgtattgtgctactgccaaagagaatagaaacctgactgaggtgtcaatgtttatgtaactgatttcatgtactttctgtagttctaccatttctgatggttaaaaatttcttgtgtgtgtgcagttggggagtgtgtcctcctccttctgctcttataccacacattagcacatcaaaatgctctaatctttgtatgattatgtggcatgtggtgatgcagcctcacagtggaaaaacttctcttgggccattgcaaatgtaacatttctttcaatcagatagtgccattaaggatttcattatggccgtcacatcctgtgacatctctaaacatgcagcattagggcctaagtgcagccctgcaggtagagttgccaggtttaacaaataaaaattacacgctggccaggcggggtggctcatgcctgtaatcccagcactttgggaggctgaggcaggtggatcatttgaggtcaggagttcgaaaccagcctggccaacatggtgaaaccccatctctactaaaaatacaaaaattagctgggcatggtggcaaatgcctgtaatcctagctacttgcgaggctgaggcaggagaatcacttgagccctggaggcgggggttgcagtgagcagagatcacaccattgcactccagcctgggtggcagagcgagattctgtctaaaaaacaacaccgtatttggggcatgctgatactaaaaaattattcattgtttgtctgaaattaaaatttaaattgggggccctgtattttactgggcaacccatttgcaatatcagcaacaatctcttattcagaccactgattaagtgtgcaaaatttgaatctctgaacagtacctatgtccttgatatcttaaattaatgagtgtcttagacactcaaagcaggaggaagcattatggcagatgtttgagccccagagatgtccatgagcacagcatagagctcagagccttctttattatttgcttcacgacagagcaaaggactgcagcaggttgactgatataaaagttttaccatgtctcacagcaggcctttgctcaagtttccagtaaggatattgtatcatttcttgcctgcagtacttgtaaatccacttacactgcctgctgttgagtcatttgtttcgtcttgagtagcatgtcatccttgttcctagaagatagtgagtttagagacagtagccaagcaacagcagagcagcctcaaccaaaacgattttccattttggtgggatgaattgaaacacaagcatcttctatccaggggagatttggggatcataaagaatcaatctgagctggtaccaccatattggctgctgcattttctagagttgccgtaactagtctcacaagctgggaggctttacacaacagacatgtattgtctcatagttctggatgctagaaatctggaatcaaggctccaggggagaagctgctccatggttttctcttagcttctggtgttgccagcaatccctggtgttccttggcccgcaggcggatcactcccatctctgcctccattgtcacacggcattttcccagtgtgcctgactctgtgtttcttctcataagaacatcggtcatattggattacaggcccgtgctactccattatgacctcatcttaacttaaacaattacatctgcagtgatcctgtttgcaaataaggtcacattctgaggttccaggaattagaacatagacatatcttttgggaacaaaattccagtgataacagtttcggagacagactagtcctggagtttgtaaggtgagccaggaccaaggtgccaggattctcattttgtaaggtccaggaacaaagtgatgttaatagaaagaacatgtttttgtttgtttatttgtttttgagacagtctcactccatcacccaggctggaatgcagtggtacaatctcggctcactgccgctgccatctcccaggttcaagcgattctcctgcctcagcctcctaagtagctggaattacaggtgtgtcccaccatgcccagctaatttttgtatatttgtgtgtgtgtgtgtgtgtatatatatacacacacacatacatacatatatatacatacatatatatatacacacacacacatatatatatatataaaatatatatttcttttagtagagactgggtttcaccatgttgcccaggctggtctcgaactcctgcgctcaagtgatccacctgtcttggactccctaagtggtgggactacaggcacaaaccaccacgcccagacagaaggaatatgtttccttccagtctcacttgactggctgcttccctagataacaacagaggatgtctgttgcagttctcattgctggggagtctaaactggaataaaacacccactatctccatcaggcttgcactagagcccagctctagctggagagaaagaagctaacccgcacagacacaggactgtaggcagggagcatccgggggtatttgggtcctggctctgatgtgcctaaggccaacttctctctggccatgctggcgtgcatgagctcactaatcttcctttttgccttccattttctccaatcctgacttagcaaaggttgggcaaaagagactctgtgtgagttcgagcaaagcctgagatgctggattttccaagatacgagaaggggctgggggctgggtgaactggtggtggaggagggaaggattaatttcccaaggaggggaaggggccaggacatcaggccccggggactttgaagagagggtcgtgggtaggaggtagatcaagtggagtgacacaaaggtcaggaaagaggaagtgtccacactgtccttcgacagacttgagtctatgggacttcctccctgcacggtacaaggaaatgagtaagtgagataatgttgtaacttctggccctctgacattgcactgccccgatgtcacagttggaaactgtacctgcccccatccttgtctggggtgtgtttggtctggggagggctggtgaagcaagaggtactcagaaaaaggacagaaattgcttcctattatctgggcatttggaggtgaaggggtcacagctctggcaaagatggggttgaaagggcccggactccagggaggggcagctctgcatggcctgattcctgcaccccacctttgccccctcacacctcctctcatctcccgtttttgaagaggaggaccctgtcacatctggacaattctgcaagaactctgtagaactgacttcactgtgaaccaggctccagaagtcaacagaaacaaaaatgctcacatttaatcacgatgctccctggcatacacagaagactctgaaaacttctgaatttgggaaatcctttggcaccttggggcacattgggaacataagccatcagtgctggtgtgtgtgtgtgtgcgcgcacacgcgcatgtgtgtgcatcttctaccatgcctcctacaaatttgacctgggcccagggccatgttcggtggtttttaagaaccgaggctcccagaagcagtattgggcagctagagtggccccaggatctatatcaaactctacctgtttctgaaccaaatttcttctagaattttattccataaatctgaattatggtgtcagactcctagcatacactaaaggaactctctgccttgcattaaataacaggagttacccctggaggtaactcctagccctggctctttagagaacagatgccgaataggcattaggggatgtgatggatgtgctaactttcaaaaaaaaaaaaaaaaaaaggcctgagctgagtgctcagagattcacaaaaagctgacagcatctctctgttccattggaagctgggtgatcctttctactctttcctgagaaaggcagttgggcaggaaaaagctgtatctctgtcctcactgagagggtttcccagtctgagggtgaaggatcaggagagggagacctgacgggtcgatgtggggcatcatccacttgagtgagaaccagagggatcccgtcattgcccagggcagatgctccattttggggggcatcattcattctttcctgttctccctgcattcctctggctcctgcccaggagaggtggccgctggcaagagagcttggtggaggtgggaggtgggaggtggggggtggggggtggggagttcttgagccaggacctagcgcatagtctccagcctgctgatggctgtcttggatgcttcaaaggggagaagatcctagatgtgggaaacattggtgggcgttctgctggggcatctgtagcctctgagaaggctaccagtctctcctaagcttacgccgtcacaccctgggcacttgttgaatgactttacttagcttacagcctctggttcctgttgggaaacttagggcttgccacagtgttcattttcctttgcgggcaactccgttcctggcacttatcatattacccactgtactccccgcttagagctgtgtcaaggttctgagaatctatcccttggcttggaaggggtcatctctctggccagatcatttcctgataggtcctgaggcaccacaacacataggaggcttgtcctctctctggggttcactgccttgctccttctccaggtcaatatgtgaccttggaccggttgcttgagtcccctggtcattcagaaacaattgggtttccctggctttggagcctggcagcctggctttgagaaccgggctttaacttgtcacatgactatggccaagttcctggggctctccaagcttcacttcctctgtaaaaagggcaataatataatacctgtcttattgggttttgtccatgttagatgagacattgggtacaaagcacttggtcccgtgcctggcacatttactgcacttaatgtatgatagttttcttattattctaataaacaatatggctttgggagtatagttctgccacattgcagtggccagagtgaaggtggtgagtgccttctggggccctgggagtcaaggttatccgcatgccctttcttgcttgctcctcagtgtggctgcctctatgtccacaccatgcagatgcaacaggtagtttgaacctctgaggcccacagtgggatggggaggcagggacatcacttatggggtgggaagtcacccattccccaggaaatggccccagctgccttttccatgactcctcttgaaaccctgtggaggccacattcgtgttggggcggtctttcccatgaggatatgttcagatgccgaggcattttgaaaagccctccatagagtttcctttcataacacatgatcatccccttgggcttctggttttttttctttcaggaccttattttcaggcaagtggcctttgacctctaaggctgtcctttcctagctaccgaatccagcattcaaagtgatggaaatatgtatatatagtaatagtaaaatatcagcacttaatggcctgataagaatgtcactgcaatgctgagtttggaccaacatttgcctgctcctgccattgagcccgggctcccctccagagctgagctgctgcaagggatctgagtaactagggctgtgtcagagtggcgatgacagccaccacatgctaaggaagagatccccaaggacaaggagaatcccacgtggagctacttgcttctttgtcagtcttgtttttcttatttcacaaccttctaaaacacaatctctcaacctctattgttagcttgcatttttcaatcatgagcacagctttacctggctccatgctttgattgactctacctgccaacactgcaacaacagggaaagggacaccggcctcataccattagatggtgtgtagcctgggcatgaggataattaaaaactcccaaggggattttaacatgtaacacagtttggaaaccattgatgtaagatcttcttactcaacatgtgctccaaggagctgttgtatcagcttatcagaaatgtagatcaggccgcacttggacctgtagaatcagaatctgcattttatcagattccgacattatttgtatgaacattagcttttgagaagtgttgctttaagagactaagggggtcaatctacctcactttgcagctctgtgttccttagtcattggctaaaatatcagcccccctgcaatgagccatcctcccttgtatagtcagtgatggcctgtgaacctttagccaactggaagtgggaggggacacagtccacaaaacactatcctgacttttgacaccaactacaagtcaaggggttccccaaaccaccctgagttgtgataattcgctgggagatctgacagaactcactgaaggttgttatactcatggttgtgatctcttatagggagggaatacagattaaaatcagccaaaggaagaagcacacagcacagagtccaggacagtgcctgacatggagcccctacggtcctctcccgtggagtcacggacagcgccactctcctggcattgatgtgtgacaacacacagggagtgttccccaccagggaagccttggtgtccagggtctttactgtggctctgtcacatgagcacagctgactgcccatgcggccgatctgttcccagactctccaccgctacacatcactcacagtccctgctctaaatcacacaccatgacccaatgtccccgggcaaatgaaaacacctctagcaggcaggacgttccaaagccttagagatcacctctcagaagctgagggcagaagccagacctctttttgggcagggttaaattctttattactgtttttgaaaaaactcccaaattgagtttttcctcttcacttacagcagcataacaacaatcatcaatgcagaagacttctgcgagcaaaggtgtgggggaaaaccccaagcagtggacactagctggtgtcctccaatttgattctgatgctgtctactgggagatagtgtcagatcctcaagcctaaaccctccttctcccagtcagagggctggcctttggaacttctgaccaatccacttcaagttgaggttccaaccactccgctctttgggtttggttgatttgctagagtggctcacagaactcagggaaacacagctaccagtttattgcgaaggacattttaaaggataaaagtaggcagataaagagatgcatagggcgaggtgtggaaaggtccctagtgcaggagcttctgtccatgtggagcgggggtgcaccaccctctcagtacatgaatgagttctccttcacctgcctatcagcctctacatgttcagctccccaacccagtcctcttgggtttttatggaagcttcaagacacccacattctttccccagagtatagggcaagaccttctctggggagggttttaagacccacagtcagaaaggtggggtggggtcaagattagagtcctgccttgacgggcaggtgaaaggggtagggggagtaggtgagaaaaattctgtttattttttctttttttttttgagacggagtttcactcttgttgcccagggtggagtgcaatggcacaatctcagctcactgcaacctccgcctcccaggtttaagcgattctcctgcctcagcctcccgagtagctgggattacaggcgtgtgccaccatgcctggctaattttgtatttttaatagagacagggtttctccatgttggtcaggctggtctcaaactcctgacctcaggtgatccacttgcctcagcctcccaaagtgctgggatcacaggtgtgagccactgcatctggccaaaagattctgtttttgaggcctgcctctgaggtctaacacactcaacattataacaagactgtagtaagggctatgggagttatgagccaggaactgtggatgaaaacctatcacagatatgcatatatatatatatatatatatatgcatatctataataactccacaactacacactgccttattgctcagttcttctctccatgtctctgacccacccttgcccccttcctccatccttttctccattgcatacccatccactgtgccctttggaatgctcacaccatgaactgcaaactctcgtgtggcttcagcctcttctctgaaagttcctctcacctattactttctctggaacctgccatccctgccaccttctcaaaaaaggccttttattctcttcattccacaaagctcagtgtcaaaacatggggtttacactggaagctgaggtcacatcagtagccgggatcagggtcgccctagctgcccaatgcagctcccaggcctcctgtaaaaccttgacctttgaggtcatgacagccctctcctgctatgctcatagctgaccactgaactcctggacactccctcccccaagttcacagagaatgtgggcacatgccttacagtcttcccttgatccaaactactgccttcatcttgagtgacagcagcatcttttggatgtcttggcctgtctagctttatttttttgtgttctgccatcaagttgctacttctgttgccatcgtgcctgtcagcgcagtgcaggctgtggtgaaatcccacgaactcaggcatcacactgaccgggtctgagtcctgtctcagttgtcagctagttgtgcaatgaagggaaagggacctacactttccaagcctcaattcactcatctatggcatggtgacaataatggaggttgatttaaagtcctttgtaagaattaagagttataatagacataaagtgctgtatctggtatacctagaaaacattccataaaagttagtaattgttggtcatgtaatgatgactctctaggctaggatttcagcttcattgcatgcacatggtgcactcacagggcgtgacctctctctgtctcagtaacctcatctgaggaccgggataatcataccgcttcaaagggatgtcataaagattaaataatatgtgtaaggctgcttgcatttagctgcattcaacaaatatttctgtatctttctcctcatttctccttactttcttgcttattatctgctctaggtatagatttcagagaactaagcttgttacaatccttcataaaataaccaggttggttagggcatttccaagagtcaatactgtttagtgactattctctgtttaatctattttgattgtccagggtcatcttttgctatgtcataggttgttggcttcttctagagaagtgagacgatggacaagttccaagtgagtgaggcgactggtcaggatattccgctgaaaaactcatgtcagttctaattcgtgattgtaattcaatcacagcctgagaacagtaggactgtagttcaaatgctctgttcccttttttttttcccagaggataatttttttttttctttgagatggagtcttgctctgtcactaggctggagtgcagtggcgtgatctcggctcactgcaacctccgcctcctgggttcaagcaattctcctgcctcagcctcccaagtagctgggactacaggcacatgccaccacgcccagataattttcgtatttttagtagagacggggtttccccttgttggccagggtggtcttgatctcttgacctcatgatccgcccacctcggcctcccaaagtgctgggattacaggcgtgagccaccgcgcccggcctctagaggataatttttaaatgtgcttttgcatttggaaaatgtgattggcatttttttctaattttctaatatgatacgctgtcggatgctatggattacttaaaccctctggctacctagaaagatctttaagtggttctcaacaagcttcatacgcaatgtaaattgtattatctctcaggatgtgtgagaacatctgtttttcttctaatgcagtaaacatataagggtctcttgggatatcttttaaatagacttaatacaacattcaggaatgataacaaaatataatcacagttgtaagggaatgtgagcatttcatattaataacattggaaccttatgtttaatacagtgttaaaagttgacaaacatgtaggagtcagaaaattcaattaaaattatcacagtaatatgaatttagccacatcctgtgttagttatgaaatccatttaacaccacaaacagtaatatttttagccagtttattcaaaaggaaaacaggaactaaaccactttcatgcaatatatactctgttaatgtggtcaggctaattttgctgggggaaggaacttaacttttgaatatttgaatgcccagtcatttaatctgaatatcctatttccttgcatgttgcaaaatttttgtcaataaaaggcagaaaaagaaatctcttctccatgctcatccctaagagaatgggttgtctgtaccctgagagcattttatggaggggacaaccacttttctaattttccttcccacttctctgtgggcacaaatgctctttggttgaaagagttgtaattcagtcccaagatgaggtgtggttactgcatccctaacctatatctggggaccccacagccacacacatgggggaaatggagcttgtcattcagttctccagccattgcacagggttcatggactcttcgttgatcccaccccacgcttcttctctctgctagccgaacacacttctctcttctttatcaggaggccataggagaagggcattcatttttaatacacatacatctgcatcaagtctaattttgccatgtctcaatccaactgtcaaatgggttgtttgggggctatggtgcttatcaaacatttactcaagaatagccaaaattagccaagcaaggagaacttcagcaacgttcccaaatggccccaaccaagtactgtaagactgaggatagctaaagggtcttgagagggacttctcaggcagtggccccgacatttatctgtttttttaagtgagaaatctgagtaccattcttgactcctcttccttacccccaacccctcactaagccttgtgctactatttagtaaacagaccctcaatgcacaaacttctgtctaaggccatggccaccaccctagtctaatccaccatctcttctctggaacagaccccagctgctctccctgtctctgtgctggtctctcaatccatgctccacactgcagccagagtgctctacaatgcaaatccatttgtgagactcctcctcttaaaatcctcaagtggcttctctttgcccccaggatcattttgaaactccttaatggaagaggcatggccctttgggatgtggttccccaacccctcccacatcatcttttcaatcagatttcccactaaatggaaattttttcaggtcctcaactttatggtgactttctcttgctcaggatctttgaacatactgtttcttctttccttttgtatttgccaagacaacacttcctctggtaagattttcctgacatcctctataaaaaaagattgagatagttgactacccaaaatgtttcccattcattccaagctctattcaaggcagtaaagtgcccggctgacagattgcattcctcatcttttctgaagctagcaatggccatgcaacagcattctggccaataagatagaagtcgaagttgaagggtgggatttccaagaaagctcgttgaagacataattcctcatttcacttcttactctttctctttcctgcttcctaaaatgcggtgcagatggcagacacttcaaagctgtctcaggcaatcaggtgatgttaaggcagaaaccagctttatgatgggtagaacaggaagaaagaaggcacctatgttcttgttcaccttgaaccacaccagcactgccttgcctacccctggaattcctttaatgagaggcaaatgagagcttacgtgtttaagccattgctattttatttttttttgtttatatgcaaaagaacttaatcctaactgatattaacactaactgggtctattgcttggtaccaagccaatgcatgacacatggtatatatgctcagtaagtatttgttgaatgagtgaggcaatgaaagaacatagaggatatatataacagtcctcctgcccagatgtcatctgatcctctttaggatctgggcccataaaactgtatctgatatagtttgaatatttgttccctacaaatctcatgttgacattttatccctaatattggaggcagggcctagtaggaggtgttttggtcatagtgataaatggcttggtgccgttctcacagtaacgagtgagtttttattctagtggttcctgcaagaactgattgttaaaagagcttggatccttccacccctctctcactcttgcttcctctctctcaccttgtaatctctacaagctcttcacctccccttctccttttgccataagtggaagatttctgaggcctcaccagaagcagatgttggttccatgcttcttgtacagcctgcagaaccatgagccaaatcaacttcttttctttataattatccagtctcaggtattcctttatagcaacacaaatggactaagacagtttctaatgctatggttcctttagtaggtcagtgtaaaaccctggatcactcctgtaacaaattacttggaactcttctcaccatacatatttaaaaatagttgccatgttgaaaatcctataagatcatattttatttcaaatccaacaactcattgctaaggagatacaagaagcagaaaatacagagagactaatgtgttgatgatttttgtgagggacataaggtctgtgtctagattcatttttttgcatgtggatgtccagttgttccagcaccatttgttgaaaagactatctttgctccactgtattgctttttctcctttgtcatagatatctggtcaccttaccttagagtcacagatgaatggtcctattacttaactactgaaaatacaggccaaagcaaacagaggaataagggatatataataaagtatttgtgtacttgacttggctctaaaggaagcattgcgtgtctgtgtaaaaagaatgggtgagagttttccaccattcaatatttctaatctttctgaaatacaaagccaggacatcctctaatccatacattccatagtttggttaatataaattcctttattaaatccttattaaataaagttatttatgtttctatgaaactcattttaactcctaagtgaaaaatactactgagctaactaaacatcaaacatttttaattttttaaatttttttagagacagggtcttgctatgttgcccaggctggctttgaactcctgtgctcaagcgatcctccaaactcagcctcccgagtagctgggactacaggtgcatgccactgtgctcagctaaacatttttttgaaatgctcttttaaaatcaattttattgaagtataagttacataccataaaagtactcattttgagtgtacagattgacaagttctgacaaatgtgaacaaccatgtaaccatcaccaaaaataaagatatgagacatttccattaccccaaaaagttcccgtgtccctctccagtcaatatccagccctagccccagctccaggcaaccaccaatctgctttctgttgctataaattgtacttatcttttctagtgtttcatacaaatggaatcatacagcatttactcttttgtgtctgtcttcttctgctcagtgtaatgtttttgagattcatctatgttctgtgcctcagtagtttgttctttttattactggataattccattataagaatataccacaatttgtttatccatttactgcctgatgggcatttggttgtttccagctttgaactattttgaatcctaaaagactgccagttttgaatgagaccccagaacaatgaatgtaggctctgtatacaagttcaggctgctgggcaacttaggccttaagacacaactctgccacttaggccttaagacacaactgacatgatggtgcttaaagtggctgtgatggaaaaggaggctgtttggagcctttggagtgcctttataggtgaaccccagcatagcacctaatgatttggagcaaagctgtgtcattccccaaagataactattcgccttttgagaaacatcttctagctactatcaataataaacacagaatgcatcaccatgggccaccgtgttgtcttttgacctgagtttccattgtgaacaagagtcatttgatccaaggcagaaagttgggtgcacacagcagtgttccatcatcaaatggaatatgagattgggcccaagtaggtcctgcagacacaaataagttgcaagagcaagtagtacaggcgcttggcctggccagtactgttgccaagttgactgcttcccctcagtctgcatctgtggcttcatggggagtttcctatgaccacttgatggaggaaaaaacaaattggagcatagtttatagtgctggtactacccaaagtggctagctgaggcactacatctccactctggggtgcccgtgaaggacagtgccaaaggaaaaccccctcagtgagcagaacttggagcaatacaagtgggtgttcattttacctagaagagaagatgtccgtgagttacagatctacacaaaatcacagagagtggttaatcgtttagtctgatggtcagggacttccaagagacatgattagaaaactggtgacaaggagtcctggggaagaggcatatggatacctctgaacacacacaaaacatgagaatatgtatcccatatgaatgttaaccaaagagcagccacaacagaagaggattttaaaatcagctgaataagatgattcattctgacagcatcagctagtctctttccccagccactgttgcccagtgggcttacatatatcatggccatgggggcagggctatgtatggacacagcaacatgaatttccactcatcaaggccaatttggctccagccattgctgagtgctcagcctgccaagatagaaatctacgccaatatggcaccattccctgggctagaaaaccaactggtggaaggttgattacattggaccatttccatcatggaaggggcagtgctttgtcttccctggaatagacatttactctggatatggatgtgccttccctgactactacaatgctctgccaaacctaccatccatgggcttaattttatttgttataaaatttcaaccaccattgcttctgaccaaggaagtaatcttacagcaaaggaagtacagatatgagcttctgatcatgggcttcactggcctcacagtgaagcaggtggccagattagaacagtggaatggattttaaaggctcagttacagcaccagctgggtagcaacaccctgctggcctggggttatgtcctgcaggatgctttaagtcagtgaccaatatatgatgctatttctcccattgtcaggattcatgggtccaagaatcatggggtcaaaatgggagtggcttttctcactatcaccctggtgttcgggtagtaatttttccttcccattcctgtaactttgggctctgctattgcagaaatcttagctcctgtggggggaatgcttccatcagggaatacaatggtggttccactaaactgacagctgagtttgccatctcctcgtgccagtgaatacacaagcaaggaagggggttcctttctcacctagggtgactgatcctaattaccaaggagaaattggactgccacttcacaatgagggtgaggagtatgtactctatgtgtctgtgattaatgtcaatagaaagtgacaccaacctagtacacagaggactgatcatggtccaggcccttcaggaatgaagatttgagtcaccaggcaaggaacttggactcactgaggagggcatattccaaggagaatattttatctatgtccatctatgtccatctatattccatctgtgttccccttggaattcctattcatgaacatggggaattccaaggggaatatagaatgagtagtggaaggtagttataaatgtaagtcaaaaaccacacaaccaatttgagaaatgaggaaggtaatagtgttgaatatgtcttctttatcttgatataaatgtatttgtgcatatattaaccagtttatttatttattattattttttgagatgagctctcgccatgttgcccaggctggtcttgaactcctgggctcaactgattctaccatttagtcctccgagtagctgggactacaggcatgcaccaccatacccagctgaccagttttttcctattcctctacttaatttctctactatacaacataatatgtgttaatggtagttaactttatatctcagtattaagtcacaagatatcaaaaagggaatgcgacttagttacaagcagaatgaatatcactcaaagatgaataaagagaagagggttagtgcattttctgttggatgagagaaagtttcattgttaggcagaagcatgattttgccttttttttttttttccaaggtctcactctgtggcccaggctgcagtgcagtggtgcgatcttggctcactacaacctctgcctcccgggttcaagtgattctccagcctcagcctccagagtagctgggattataggtgcgccaggttaatttttgtatttttagtagagaaggtgtttctccatgttggccaggctggtcttgaactcctggcctcaagtgacccacctgctttgacctcccaaagtgctaggattacaggtgtgagccactgtgcacagtcaccacggtctttttgggaggcaactttagcatggttaagaggtgcgaatggatgttaagctaacaccaggtaagccctggtagatgtgtattgtgtcagtgggcctacgctggagccatgtttccccaaattcacttttcctatgtacctctggattagtgtgggccactggagacatttcacatgagatgaggaaggtgggagtgaaggagcagcatctttttacactaagcaggtcggggagggcatgtggctctgtctcacattgttgggaatctgtccatcatctggttggcttaggtcagtgggtgagttcacagctgttccagcttctgctggaaactccttcggtttctctgactgctccgtgatgagggcatcagattctcctgcagaaagccccagtgttgaagttggggcttcatgttggtgagtgatagttacgggttctagcccaacctgtggtttcttgcaaatttcagtgtcagctcagtcttgcgggttttgggttgtccttgcttcccacacttcatgcctttctttccctcctgacagtctgccctttagattttaggattcagcaccagccacagaaacagcaacctcactgttaagggttgaattgtatctccccaaaaggtaggttgaggccctacctgccaggacttcagaatgtaacctcatctgggaatagcatcattgcaaatataattaattaagatgagggcatactggctcaggatgggctcctaattcaatacaactaatgtccttctatgacagccacaggaagacagaaacgccaagggagaacaccatatgctgatggaggcagtggcagctgccagccaaggattataaccagaagtcaggaaaaagcaagaaggaatcctcccttagtgattttacagggagcatagccctgctgacaccttgattttggacttttattccccaaaactgtaaaacaatacacttctgttgttttaagccactcagtttgtgctactttgttatggcaactccagaaaacaaaaatacactcagactgtttaatcaacctccataattgcataaggtctaatccctataataaatcccttaaaaatgtctgtgtatatatatttaaaaatataaaatatcttctagtggttctgcatctctggtcaatccctgactgatacagaatatgtattttcatttctaatgatgaaatacctgaatgaaatttctaggacatatggtaagtgtatgtttagcttttaagaaactgccaacttgggggaattgcttgaggccaggagttcaaacagcctgggtaacagtgataccctgtctgtacaaaataaaaaatattagcagcgtgtggtggtgtgtgtctgtagtcccagctactcaggaggctgaggtgggagattcacctgagcccagatctttgaagttatagtgagctatgatcacgccactgcactctagcctgggtgacagagtgagaaagctggtctctaaaaaacaaacaaacaaaaaagaaactgtcaaactcttcccaacatgttgccatttttacatttaccattttacattcttaccagcaatgattgatagttccagttgctccatacccttgctgaccattccaatagatgtattgtgttatctcattgtagttctaatttgtatttccctagtgattaatgatgtttaacatcttttcatgcacctattggctatatgtatatcttctttagcaaaatatatgttgttatttgaagagcggaagttttacattttgatgaagtctaatttattgattttttttttcttagatggctcatgctttttgtgttatctaaaaaaaatttgccttcttcatggtcacaaagactttctcctatgttttcttttggaagctttatatttttagtttttatgtttatgtttaagacccatttctagttacaatttgtgtgattttttggaagggtcaaggttcattttcttttccataagaatgtacagttgttctagcacccttgttaaaaagactttcctttccccattgaactactttgtcaaaaatcaactgagcatatatgggcatcatgaattttaatcctgttagaactgaatgttcccaaggcaggccatgcccatgactgacctcctttccttggattgcctacaaaacagataaagctaagtctggagcaaagaaatccatgtctaacctgtatttttttttttttttttttagatggggtctcgctctgtcacccaggctggagtgcagtggcgtgatcccagctcactgcaatctctgcctcctgggttcaagtgattctcctgcctcagcctcccgaggggctgggattgtaggcgtgcaccactatgcccatctaatttttgtatttttagtagagatagggttttgccattttggccagactgtcttgaactcctgacctcaggtgatctgcctgcctcggcctcccacagttttgtgattataggcatgagccaccgtgcccggccttaacctttgttttcttacacaacacactacgtgatgttttccacatgcatgggtcatttgcttcatttacgtacaaatgcataagcaatatactgtgtggtgtgagtttgtgatgggaaaaggaagaagttttgcggatactacactggcttcctgctatctgtctgtgtgaatggctatggactttgtcttctatttgttcgcttagcgcagatatgatcagcttacaacttaagattctagagaaagagggtcatatctgtaaagcactctgagcatgtgtgaagtttaatcaatagcatatgaggttacagcaaattcactatctttgtttcttcagctatagaatggcatgaggattcatctcaatttagttcaattctgttcagaaccatgagctagctgttcatggaaggaaagcccacctgattgtggccagggaaggagaaacaacactttaaccaggttgatttggttctcacagacaccattggcatgtgacatctggaacagaccatgcctggtctctgttcgtatcacttactattcagctcaatattggtctgaatattctttagactgactgaaatgaaaaggaactgttgtgtaaccatccataattccagcctgtagacctgggctgtatctctatgccctgcctggcacagaccccacctcctgctccttctccctcaccaccagtcaatccttgtcctaatgaacagggagggcaaccctgaatggggagtggagggaagagatgtcatgagatggcaacgtgcaccctgaagtgaggatgaaggctatgtgaatgttgtaggctgacagccgggcatagtggccccgttgccatggcgatggaggcatgttgatgcgaagtgtctgcacagctcctaggatttttaacagcagctgggcagagcctcggcgtccctgaattgttgcccccctgagtcactgcttggccccagctgtcctgatctctgttgacaaatggttgtccttcacagtcaaactactaacagtactctaattaatgaatgtgctaattattcttgcctactcccagcatatttgtctaactaacctgtcacacacagatcagtgcagcatatgcataattacggagagcgctgggagcaggggatgggtgggagaggggtgggctcgcagccctgtcgctgtgggatatttcttgtaaagttacctttgctaacggtcagatgtcgtggggatatgttatttcccgtgaagtgtatatgtcttcctttctttcctttctaagaatctctcttcagggctgaggggccattgctcagtgctttagcctgtgaggggattgccaggtacaaatgcagaaggaccagggagcccaggttctgaagacgattccggtagcagcacgtagggtgattaaaactccagactttaaagccagaccggcctgggcttgaacccttgttctgctccttgctatgtgggtctttgccttgaccacattttttttttttttttaagacaggatctccctctcttgcccaggctgtaatgcagtgttgcgatcacagctcactgaagcctccatctctacagcctcaagcgatcctcctgcctcagccccgagtagctgggactacaggtctgtgccaccacgtccagctaatttacttttgtagagttgggggtcttgctatgttgcccaggctgttctccaactcctggactcaagccatcctctagcctcggccttccaaagtgctgggactataggcgtgagccacggtgccaggcccttgaccacatttttaacccctctgaacctcagtttcactttctgggcaatgggaggggggtaatttgtccctcagagggttgcactgaggggcaaatgtgaggctctgggtacaatgcccagtacagactaggtccccacgacacagccgctcagcggctccggattctgggctgctctggactgcggccaggcggtcttctgcgggaatccgggcaggcagggcgggctgcgctcccctccccggctctcccggtgccccttgtctttttgttctgtctcagcagctctctattaagatgaatggcatttccaaaggcttcacctctgataagtgttcctctgcagctgcagccagaatcttaatgtgcgcgctgtaatttaatggccgtctcggctattaacacgctcttctcgggtgaagtggactccctccatccccgggcctctgcacgtgctctgcgcgctggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttttatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactccacagttggtgaagatgtctccaggaaacaggtctgcagagagaatacgtttgacatgctaagagaagctgagagagagcgagaggagagattggaagaaagacagagacagaggtagagagaagggaaagagagagagaaagggacagaagagagagaaaaaagagggggccgggcgcggtggctcacgcctgtaatctcagcactttgggaggccgaggcgggcagatcacgaggtcaggagatcgagaccatcccggctaacacggtgaaacccccgtctctactaaaaaatataaaaaaaattagccaggcgtggtggtgggtgcctgtagtcccagctactgaggaggctgagacaggagaatggcgtgaacccgggaggcagagcttgcagtgagctgagatcgcgccactgcactccagcctgggcaacagagcaagactccgtctcaaaaaaaaaaaaaaaaaagagaggaagggcgggagagagagagagagaaagctctctagctccaaggcctaaccacatctctgttcttttcaacttcagctgtcagatttttagactctttgagtgaataaattctcctttttgcttaaactagtttgagctaagtttctattgcttgcaactggaatactttgtaagaggactggccttcatttctgatgcattgtcactaagatgtaagtgttagaagagctaacgctttatggggttcaaactccttggctaccaaaacctaaacatcccctgaaacttaccaaactgcaggtatgaattggatctcactaaggtgaatatacaaatcttgcaagtgctgagccctaaccaatcttgtaataactctgtggtagttaattttatgtcaaattgattgagctaaaaaatgcccaggtagctggtaaaatgtttttttctgggtgtgttagggagggtgtttctgaaagagatcagcactggaatcagcggactaagtaaagaattcccaccctcaccaatatggtgggtgtcatcaatccactgagggcctgaatagaacaaaaagcgggcagaagggcaaattccctcttcttcttgagctgggccatccatcttctcctgcccttggacactggagccccttgttctccagcttttggattcagactgggtcttgcaccattgccctccatcttctcctgcccttggacactggagccccttgttctccagcttttggattcagactgggtcttgcaccattgccctccttgatgctcaggcctttgaatgcagactggtctccaccagcagcttttctgagtctccagcttgcagatggcaaaccatgaaacttcatggtgtccatgagcatgtgaaccaatttctattataaatctgcaatatatatatatgaggagacttatttatatattggttcagtttctctggagagccttggctaatataaagtctatactctacaaagtgccctaggtactcagggagtacccaagtgtgtcatgaccagcccgacagccctggctgctggcttccccgcacacaactctgcacgctgccttcatcagcctttctctctcagctgaaccgagggcattgaagcgggcctctggcactgtacctatgagggagcaatatcttcccctacactgacctcttccgtgccgagatgcagccctccctgctgccactagttacagtggtccatgttccctttcaaagtgaagttttgataaaagcacctcttaaccaatgccaaatagctaagtctgggacaaagattgcaggtattttgcattttccatgtaacctcagagggattgccattcacactgatctgagctgcagaataccaggcagccacctcacccacccagcaggtccactcttatactttctcagaaagcacagccactctactcttattcagttgaaaagaatttccaggaaggtgtttctgcgattgcctcagaaaagtcagttccctttgggaatttcccttagggatcatctgtaactccatttctgccttttacctgaattctttggtttggtttgaattctttggtttaatttatgaattccctttattacttttctctgaagaaatggagatatcagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttacatttgtgtgtgcgtgtgtgtgtgtgtgtgagacagtcttgctctgttgcccaggctggagtgcagtggcataatcattggctcactgtagcctcaaagtcctgggcccaagcaatcttcccacctcagccacccaaaatgctggggttacaggtttatgccactctgtctgacctgaaagttttgggtttactttcccttctttctctttgctgaagtcagagatgatggcagcttccagattctctggtgcctgtgctgggctcgtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaaaggaagaagaaggcactgtgtaattgtgccggggatcttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcactcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtgattaccagtcccatttttagagccagggctgcaacttgaaggttttgctaaaaccctcaccgaagtgtctatgatcagcattttaactattaattaatgtggccaggcaaggggtggaaggtgagaagactagaaagggaacatgatatacacatttactcagatactgggcttttctaacatctgcagtgcaattgaagttaccagtcatctgcagtctaaaaagaaagtgattttgggaggtgcgtagaaaaaatcatcttattatttttcctctatattacttttttctttttttctcctgaagaaacttttttttttggtgataccttctttttctctagcacgtataattttggaagcatttttcatatgcagtgtatacttcagaaagagagagagagagaggaaaattgtcctgttcagcgtttgcatttccattattcctgctattagttaaaaacaacaacaacaacaaaaaacaagcaggatacctagatctggaaaagggagaattgtgtagagctgtcttcctaaagttctgagttagggctgcctcagaccactttcataactatctccagtggctttgtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgtggacagatgctggtgatgtagccttctgggcacagagcaagcctccccctcagcctctgcaccagaaaggctcagcttcacacactccaagtatgttttctacaagaactacactttgtggctttctgacccaaacatttttatactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcctgcagtctctgcaaaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagctacgaagtttgagctcactctctccagctccctctcaattcagagctgaactgtgggaagcttcagagctctctgtttcaaggacaggttctcctcacctctcctaatggaggtgcaccagggaactggccctgctctgcccagggctttctcctggactttgccatcatggtctagcaaaccctgttcagattgaggtgagtggtgagatttcgaattctttttgacagataggattaagtcttcttctgtgggacaagtgggaggtagaggtaagattaaagatggccaaatgtctgagtcctgacagccacaatatggagatctagactttttacagaccacagggcacaggggcctcactaacagagttcccggaagtgatgagtgtgctgggggcttcctggttgaagagacactagaatggaccagctgggagctaattttttgggctggagtgtgatggcctgcacatcactgcctctgtccctccattgtcacagctgccccttaggagccagctgaggcaatttgtggtcagagtgactttgcacagttgtcctgcctgtgttcaggaagggagtttctgtggtccctttgaaaccacagaagagcccctcgtatagctctcaatggagggggcaaaacattcaaataactcaggagataacacaactatttgtttttaactgtgagtttttaggcaatcacaaagatccagatgtatgtccaagcctctctttgcaattctaattaacctcaatgttgcaaccatagacctaccttacagagttcaaaaaaatatgcaaaaaccctgcctttcttcttcctcataccccaaaatgccattctgaacatttcctgttagttaaaaaaagatttccatggtgttaccaggcactgtacacagtctgtgtcccaagacaaggaggtacagttccacatgcgcccatgactgggttgggctctgcactctctctatactttgagagcctgattttctgtgattgggcagagctggcccacctggtgcaatgtcctcctctgcctttcaaacatgttttagtcatcaagatcttcaaatttgtaaccctttccagcttgatccagcagaatgcagatttggaaaaacagaacgagtttaaaatacatgattctaagaaacctggaccagaactatcaaaacttggtttcccagagaatatagcaaatgggctcattggccaatactatgacattggcttttgagaaaagaaaggctttattgcaaggctggccagcaaggagacaggagttgggctcaaatctgtctccccagtttggggcttagggcaagttttaattacacagacgcatttcttatgagtagcaggcagagagcctccaacttcttctgcctaggtaccagcagcttagacatgatgcaaacctgggaagcacatactgtatttggagaaagtgattgggaagaaatgtgagctgaggggaggggctcagtgcccctgagctacacttagtgatggcagaggaaggatgtcctcccgcaggaggctgttccacatctgctctggttgtagggggagctggcaggcattagcagcggcctctttcccccaagagaggcagcctcctccaagttttggcgacattatggccctgcaatcataagggtttgtgagcatagtgctaaggagggaaatggagctgctgttactagttccaccccaacacacacacacacactcacaagaaacctcacaagcaccgtattggaagactttgccatccaacctgggatttgacaggctctagaagcagaatcatagactcatgaagttcccccaaagcaggaatcttccttacagtaacccccaaccacccccctccaccgcctccaccggctgcttcttcctgaacactgcagtgtttggaaaactcacaaacttccaagcttgcctttcctattgttgcatggattgaaagcttgcgttgtgtgaagaatggcgcttcctgctgtgcttagttttatctcatataatctttgcaccatttaatccttgcactcacccactcatgcaactgcctttgcagagactggaggggccgctgtaggctgacctttccttcactgtacctattttgttccctgctttattcccctgcacccaggacactgcctggcacaaagacaggtctttataagtgtatgcaagtgaataaagatatatatattattattgttatttttgagacagtttcactctgtcacccaggctggagtgcagtagcgcaatctcagctgactgcaacctctgcctcccaggctcaagtgattctcatgtctcagcctcctgagtagctaggactacaagcatgtgccaccacgcccagctaatttttgtatttttagtaaggacagggtttcaccatgttggccaggttggcctccaactcctgacctcaagtcatcctcctgcctcgacctcccaaagtgctgggattacaggcatgaaaccagcctagaaatacatactattatttattcttgttttacagataagcaaagtgagtcatggagaatttggttgaaagtcccaaggtcaggagtcgtgaagctgggattaaaacctaatcatctgactttagagagtagacacttgctccatgcatattgcctccaattcattcattcaagcactccctgctcaagaagttctttcttatgttgagctgaaatctgcagccctatgcgttttacccagcagtcctggtgctgttccctaaaatcacttagactgtgcctgctctttctgtgtttacagtgtcagctgtaatatccccctcttcggcctaacgtttctgaagtcccttgccactgggtctcctctcctcttcctgtgttctttctaagaacacctatgcagataggtgtcttctgtacagggaagctgttcctgagatccgggcatcgactctgttagaataatctacgtatgagttatttttttgagaactatgtgtcattgctgactcatattaactctgtggttaactaaaatctcaagatctctttatgtttgttgagaaacttatttaacttctctggccctccgtttccttcactgagcagtggagtgattgataacctccacctgtggttgctgaaggtcttgcacaagatgatatagttaaagtagctagcagtgcccacgtacggcggatgcctcacaacggtttgcagccatctctctatctgtgtctttgtctctctctcacactggttttggcttactgttagcagctagccgagataagtgtgtttatggtctttgcatgtattgtttctgtagcatactggaggattacaagaggttggggagtgagggggcggtgaggagtagacaaaggcagccaactcttccaagtttagcttagaaggaaggagcggtaaaccctagttgaatgttggactgaagcaggtttgtttttgttttgtttaaaggatagggaagatctgtgcgtgtttccaggataaagaaaaggagagaatatgatattaaagattctggaagtgggagaaggagcaatgaaatacagacttgaagtcagtggcatggacagggtcaagatcacagttagaggatgcagccttagagaaaaggaaggggctcggttctctgagcaaggagggaaagaagagaggcagatgcagagaagtacggcacatcgtgctgctggttgtagaaataacctctgacttttaataaagtcatccctcggtatccctgggggattagttctatgacctccctcggatgccaaaattcgtggatgctcaagtccctgatataaaatggcatagtatttgcatttaacctacacacatcctccatatcctttttttttttttttttttttttttttttttttttgtgagatggagtcttgctctgtcgccctggctggagtacagtggctcgatcttggctcactgcaagctccgcctcccgggttcatgccattctcctgcctcagcctacaggtgcctgccaccacgcccagctaattttttttttgtattttttagtagagacagggtttcaccatgttagccaggatggtctcgacacatcctccatatactttaagtaacctctagataatctctagattacttgttttgtcttttttttttttttttctttttgagatggagtttcactcttgtcacccaggctggagtgcaatggtgcaatctcagttcactgcaacctccgcctcctgggttcaagcaattctcctgtctcagcctcctgtgtagctaggattacaggcccctccccacccccaccccccaacaactggctaatttttgtatttttagtagagatggggtgtcaccacgttggcctggctggtcttgaactcctgacctcaggtgatctacccgcttcagcctcccaaagtgatgggattataggcatgagccactgtgtgtggcctagattacttataatacctgatagaatgtaaatgctatgtaaacagttgttatactgtattgttaaaagacagtaacaagaaaaaaaatctgtacatgttcagtccagacaaatggttttctgttttttttttttttttttaatatttttggtcagtggttggttgactccaggaatgcagaacccgcagatatagaaggttgattatgcgttcagaggcagggaataccatcttgggttccagaaagaaaatgatcagcattttctgtcatactctggtaaaaacagatcttttgaatggacaggtgtattaaaccctgtggagctggctgggcctggcggctcacgcctgtaatcccagcactttgggaggctgaggcaggtggatcacgaggtcaggagttcgagaccagcctggccaatatggtgaaaccccaactctactaaaaatacaaaaattagccgggcgtgatgacgcatgcctgtagtcccagctactcgggaggctgaggcagaagaatcgcttgaaccctggaggtggaggttgcagtgagccgagatcacgccactgcactccagcctgggcaacagagtgagactccgtatctaaaaaaaaaaaacaaaaacctgtggagctgatgaaatcctgcagggagcttcacggtgacagcaagaggagaaacacatccccatatgccccgcagagtttgaagtcccggctgcacctctccccagcagcaggttgactctggaaagttgcagcgttcttacctacagagtgggaacagtactacccattgcacagagtgggtgcaaagctctgtgacggaatacatggcaagtgcccaccacattgcctgggatgaggtgggcccttcctttacgtaagagagccctacagatacactcaaagtgggcacattcctacagaaggagtgttatttgtgtagaaaagaaaaacatgaaaggcttttattcctatacacaataaagcacccctttaatgtctttttgaggaggataatatgaaattgatgaaaaggaaccctgtggttggatccctgacaatcacatgtatcccttttttcactcttgaaaaaggagtaaaggaataaaatagaaggggagagggggcagagagaccttcaccgccccccccccaccccccatcatccaatctatagtcaaaccctccagactgtgtctccttggcatctctgacacccccaccgccaccaccccagtcaattcctatcttatccccctatcctggatctgattctgctaagttcctgccacactaaagacagggtggctttctgatgacaacattcctctgcttaaacctgtcagtaattccttgttgctctcagacggaactaagttctgaatttcttcacacggctctcagcaaggtcacagtcaccctgctaggccccaggggcaaatctcaatggtcatcttcttgaagacctggctcagttatttctttctcattgaggctcacgaccccaccttcttgcatgcctcaaacggccccttaccatgctcttctttcgcccatagctcagcacaccatatcattttaatttatgtattttgcttaatgtggatgatctgtctcctcctctgctgtcctcaccagagcatcagttcctcaaaccaaggctctttgttttgttcttggatgcaagctaaatgtctggcatgtggcaaatggtcatagatacatgtcattgaaagaatgattcatcacctccctctttggccttgtctgtggttctaccaaatcccattccctccccagtgccctccattccccctccttggctgaacattctgaaccacagacagttctttaccctgaacctttgcatattttgttctcttagcttagagcggcccctctccctccgtctgcttggctaatttctacttgttcttcagattttatcttagatgtcattccctcaaggaatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagccttcaactcacccaccccttgctcccctgcgggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctcctaaagatgggtgcaatctattcgggatgcaaatccgaatgaatgttattcaaatgctcctctcttctttatgcagagtgtatttcaaggctcagccagtggcaggcatgctggggactatggactacggactaggggcctgtcacagaggaaggcctcatgctagagagctaagggaggagctggccttcagttccatcccaggagcaactttgatgttcccagagatccttccaaagggggagtcatggtcacccaagaaaaatgtattcagaatgccaagaatggtgcaaactcaggacaaagattcacactgcagggttggagtccctgggcttgctgctggcaccatgggagggagggtccccttcaggggtaccgttggtttcctgtgaattaaactggcttcaagggatctcgactgaacaggcctatatcacactcactgatatactctctcttcagtccttctcctcatctaggtatttttaattgtttcagtgaggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctttcagacagcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggtcttccatgtattaattctcagaatcaatttaagatgtttaaaggtgtgatttaagacattttaaaaccatttggaggagagtacagaaattatgtcacttgctgtcagcctctttgcaccatctgcagagaaagatactagagtcccgccttggacacatccacatgcaagaggtgcaaagaaggtgtctttgatgaggcaaggtcaaaacttctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggttagaagttaagtttccaatttgctggcaatgaagaagaaatggagcaggccaggctgtgtagtttctgccacgtgcccccgggagtgaacagctctgtttgtaagaagccatggtgcttagacctgggctcgctagttgccagcctccaaattgcagaagtgccctttggttggtggctatgctgtgtcacttgggaaggtcgtttggaagttccacagtcgttgtggggtgccagagattaaaaagcgtaagaggagagtggaaagtgattgttgctgcttgggcatccccaccgtgtgggtgctgcagcccagctctcaaaacccatgggtctgtacactcaacctccatgagagggaaggagaaggatgagggaggggagagatagccatggaaaggtaggaactaagcaggcagggtggagagttttctgtaagacaaaaactgtctggacactgctgcggttctgttacaaagaccacttcctccctgggccagcaacatatctgtgtgcctgtctgggttgtaaaaagggtcaaagatcaatgcagcaggcagctacatgctggcaaaagccagaggcagctggtctgtttgcctgtgccaggaaaccactgggaatggggttgtgtgttattctaggagaaagtcgtcccagcagcagcttctccaggggcatccaagagcactgaaaagggttgcaagatgacccatgaggctgcaggaagaaaagaacatgcatttaatcttgctatctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggtggattaaaaagacagatgcatgtatttttagcataaaacacaactgctgactgatacagatagctcaagattctggggcagctgctgaacagatacactagccagtgtggctcatcggctcagacttggccttaattaatgggctgtccctccacccatctcccatgagggcagagctgagccagggtttgagagctaaaaggaattggacctggactctgttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcctgagtagctgggattataggcacatgcccccatgcctgactaatttttgtatttttagtagagacggggtttcaccatgtcaggctggtcttgaactcctgacctcaggttatccacccgccttggcccctcaaagtgttggaattacaggtgtgagccaccgtgcctggcctgttcacatgtataaaacacagtttaatgtcctattcccagccaatgagcatggctagagcagccttggtcaaagtttggtttttggagaaaaatccttgttagctgacctaagattcctctttgtgagtgtaagtaagcacaggttgcagagaggagaagggtctctggagaggtgtaattttctaaatggattacaagttcatggacttttaacaggtgttacaggggataacaagttctttatagacagacttttgaggacgtttaagggtattctgattcttggttttctaagaggggaatgtattatttaactacagacacccctaccgcccactttttgcagagtgtatcaaaacatgtttttggaataccaccctcatgtcgcttctccctgcatctcttatctcttggtgtccattctagactcactttctttctgttttttatttttatttttttttgagatggagcttcactctgtcaccaggctggagtgcagtggtgcaatcttggctgactgcaacctctgccttccgggcttaagcaatttttgtgcctcagcctcctgagtagctgggattacagcatgcaccaccatgtccggctaatttttgtatctttagtagagacagggtttcactatgctggccagcctggtctcaaactccttacctcaggtgatctgcccgcctcggcctcccagagtgctcagattacagacgtgagccactggtgcctggcctagactcactttcaagtggcatagacttgtaaaattatttaaaggtgataggtctacaatgatcctgtcaattagtattgacactattattaataaactgttattaattatatttacttactttaaattaatccaaactaattaacggaacactaaagagtttctatgttttattcccagaggtggagaaaaatgaaagggaatatagcaacgaattcttttctccataaaaacatgaatagtgcagcacatcaagttgaacataccacagcaaattgttgcaagatctgctgagtagctcctatttagacctcaaggaatgagactcaaaatgggttcatcagttctgttttgcagaaaaaatagcgcaaaatttctcaaaagaaaatccagaataataataatttgtcaataggaaagacatttccactgggggttaagaaggaagacattggaacaatgatagccaccacttattgaatgcttactgtgagccaggtggcacttcaccttgtttcattctcacaacagtctagggaagtaattactaatgtctccatccacctcttgtagatgagcaaactgaggctcattgaggctaggaaatgcacccacactcacatagcccataagaggcagccatggcattgggcccagaccatgtgaacttcaaagactacacgagcagccactgggcagctgtcatggctaaagccacttgaattcagcccagcagcaaccccctctccaggaggggcacataagcttgcagctttgggtagaagctgcacttgaagtcctggatggcgagagggactggcttgagccagagccaggaacaaggctctgagaatattctggaaatccacaggaggaacccattttcttacagctgggagaatttcattcaactccaggctgaccatgttttattaggaacgaaggtgacttgaactaatagtcaggaatggttgaatacggacccaatgtcaaatcactaggcagttcacatttctaatgagcaaatcccttagacaattaagaatttttttccttttgcataacccagacaaaatcgctacttaaaaacaaaccaaagacccgaaacatgagaaagagaaggaagcaggggaaatctttggtactaataagtttttaaacaataagagcaccagatattttaccccatcagacacagaatgttattcgaataaccaaaaaaggaattttttctctaagtttcttgaactggaaaatgaatcatattttctcagtcctgaggctgcaattttgtgcctctagtaacatataagaatagatgtgatgccagtgcccagtagctgctgcaattgttacttggggacctgtttattcactaagcacttcaccccagtgataaatttgtaggggcctcctgccctttggagctcctaccgtgtccattagatcagtggaaattctgggattcagagcactttgcaaggtcagcaggggtctgctctttctgtcctgttcctggtttttggttgtgcctggattccagggtaggtttctcatctgttaccttcatagacttctccagaaaaggatcttttgaccatcagaggaccacgaagattccattggtgaggcgcagataacctgatctctctgggttctctgcagggcacagatgaagggctggccattcccaagttctcagtggtaccactgaggcatgagaccctaatggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggtgtgaacatttgcatttctaacatgttctcgatgctgctgccgcctctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctctgtatttatttccctccctttttatgcctctcaagtctagttacactgtttttcatggatgggcatatttattgtcctgatctggactgcagacttctcaggaggacacctatgatttaatttagtatagttgaagagttaacagacatggctttggagacagactgattatggtgtgaatcccggctttgccactccctagctggatgaccctgagcaagttattcagcttctccaagcctgagttccttattggaaacatgagagcaattgtgataggcagaataatggccccctcaccaatcatgcccacatcctaatcctaggaacctgtgaatatgttatgttacatggcaaggggaaattcaggcagctagccagttggccttaaaataaagagattatcctggatgatctgggtaggacctgatgtaaccacaagggtctttttaatgtggaagaaggaggcataagagtagatgtcagagtcattcaaaataagaaagatttgatgggccatccctgactttcaggttggaaggaggttctgagtcaaggaatacaggtgacctctagaagctggagaaggcaaggaaatggtttctcccctagaagttccagaaggattgcagccctgctaatatcttgactttatagccctttgagatttattttggatttctgacatcctgaaccatagtaaaagggtgttttttgtttttttgagacagagtcttgctctgttgcctgggctggagtgcagtggtgtgatcttggctcgctgcaacctccgcctcccaggttcaagtgattctcctgcctcagcctcctgagtagctgggattacaggtgcttgccaccacacctggctattttttgtgtttttagtagagacagggtttcaccatgttggccaggctggtcttgaactcctgaccttgtgatctgcctgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgaggactgtgcccagcatacagtgatcaccctcttagtaagctaagtttctgagcaccagcttttttgagttgactttgttgtctttaacatttgaagatcacccttctttgctcagcctggcttgcagacctgggctgatttgtggatctgatagaaaagtttccttagttgggctcttctccccgaccacccccatgccagtgtggccacatcctctgtctgcattgctcactcttcaattccaagaagcgcaggggcaccgccaggaacaggaaccctgccagaggaatacatcaagaaaccaagtctcccttacgcatcaccgtaggaacagagttaatggattatgaacatgtgtttgctttataccattgtttgtttcccaggtggcagctggctgccccatcttattgggtagatgtaagtggaattacgaatgggatttatgtttcatgcacgatggtgattattaacttcaactttcaggtaattttcagaccacattgcactaacttggtctctgattgtttttctccttgtttgtttattctgcagccagaactgtgtagatgcgtaccccactttcctcgctgtgctctggtctgcggggctactttgcagccaaggtaactcagacttccctttgttcattctccttctataaagtgcatctcaaggaggttcaaagggcaggctttttgttgaaaggactttgcctgacctctggctcccatctgtgaagccctggagaggtgagagccctcgggaggccgtgtttcaggcatgctctgcacccgtgcagagcgcgtgtgataatgcattgctaatgcttgctccctggtggctggctgagagctgctgtgctgacaagggtggtttaaggctaaatgtgactcagaatccttaagcagtgttagttcagatacaagggcattataaatgagagtgcctgagggatctattttgggaccgctgtcacttggctcttctgctaataagcttccagtgtggtggccctccttcaggcatgtttccactgagccacgggctggatgccacatccccggccttcccacagttatcagcagcccacaggcttgacttgagcaagttggaaagacaaatcaacttccagagttgatttaacattgagtggaaatcagtcatacttttggtcccctttcggggccacgcctggcactgtgcctggtggcagatcggcatgaactggccagcttctgtggccctggagggcacaggcagaaaggccacactcagtcccatgatgaactgtttaagacttattgttgtctccccgctctgtaaagtagatagagtggattttatgtcccttattacctttcaggatactttgactcagggagataaagtaacttgggtacagctactcagctggtgaagaacacaggcagaatgagtgcctgggtcttttgacttaaaattctggatttttcacaaagatcctcttactttattcatttacataataaatatatattgaagagctactctgtgccaagccctgtgcctagatatacagtgataaataaagagtagcttctagaggtcacctggcggtgaggcacaggccagctggcaagatggaccacagaagtcagtgaatgaagacaatgacaagggtgggaagcgccatatgggaagagaaccaagttcagtgatagagagcagaggtgaggcggcagcagaaaccacttaagggacaccacgtggcactccttctgtgctgagaaggctgtcagtaagctcaccatttatttcctattttctctcctgagttaaataggaaacatgtctcgcattacttgaaaaatcaagtcaaactatgctcttactaggagttatggttctttttatgtcttagatgatgcttgatctagatgaatgcggacttgctgtagctagataaatacaatgggagtttgaaggtgtttcgtagccctggaaataggtatttcctgtcaaaacaagctttgtcattgccagcagacaaaagcatcagtaaccttggttgataatcgtcatttcttaggaataaagtagactgtagaattttttttagcagaaaggaaacccaaagataattctagtgcaaatccctcactttatagagcagaagctcaagtcccagaggaacaagtggcttgaacgaacatcagaattttaggggctggatttgtaccctcctggtgccagcagcccacttccctgcaggaggcactcaccttccttgcacaggggtatgagtgtggccattttccacccataatctctgttagctcatgttcaattgggttcccattgaaagaaaaatggaccagtaagttggagcagaatcattcagatggtataacataaggaaaaactttgcccaaggcaaatcgtgattgtgacagctttgtgatttttagagaatagcatgggccaggcacagtggctcatgcctgtaatcccagcactttgggaggccgaggcaggcaggtcacttgaggttgggagttcgacaacagcctgaccaacatggagaaaccctgtctctactaaaaatacaaaattagctgggcgtggtggtgcatgcctgtaatgccagctactcgggaggctgaggcaggagaatcacttaaacctgggaggcggaggttgcggtgaaccaagatagcaccattgcactccagcctgggcaacaagagtgaaactccgtctcaaaaagagttcacagtttctcttttgctttgattttcttatctgccggataacaatagtattttggaaggcaggaggaattgtggaaagaaatgggttttggggagtggctgattggaggcaaatccaaggacactcattgctggtgtgtgactccaggcagttactcagcttttccaagcctcagtttccttattgtaaaacaggaccatggtctagctagtagcattcctatggtgagtgaaataatatgtataaagctcctgacacagtgcttggcatatatcagattgagccatgtaaaactgccaatatctggctatttatgacctacaaaaatagcatttcatatgattccacctaacatctgaagcgcaataaatgttattattgataatgcaggtggtggtgataaagttttgaaatcagaaagacctggcttcaaattccacgccttcactggcctgacttattttcattcatttgacaaatattattttgaacacccctatgtgccaggcactatgccaggctcagagatgatctaggaaaaagacagatgtcctcatctgtcttaggctcttgtggcctaagcctaaatttcctcgtctgtcaaatggtgacagtaacacactccttaccagagagctgggaggattggagactcaagttcccaaaacgccaggagcactgcggcaggtgaaaagtattccctcaatggcggaagtgtttaaattgcttttatatctgtagctctagataacactagttccagcttagttaactcccagctccaagccttcaggacttcatagagttattggggtgctgctcttggcagtttcccaaaaagctagaatgcagagggaatctccttcccaaaaagctagaatgcagagggaatctccttcccaaaaggctagaacgcagagggaatctccttcccaaaaggctagaacgcagagggaatctccttcccaaaaggctagaatgcagagggaatgtccttctcttctaaatggtagctgttagttcaagaaaggttaaacattgtgctgtggggaggctcaggggtgaagggtgtacttttaagagaaccagtttcagagctgggtttggggtttaagccctaccctctgcccccttttacgagctgacagccttatgcaagcctggttgaccacctgaacccacgtttccacatctggaaatagaaatgtgggtactagttatgttgaaaggactcaggttagatgatagatatgcaaataccttggaaaccaggagtgtccagtcttttgggttccctgagccacactggaagaagagttgtcttgggccacacatagaatacactaaccctatcaatagctgatgagctaaagaaaaaacgttgcaaaaaaaatctcatatttttaagaaagtttatgaatttgtgttgggctgtattcaaagccatcctgggccacgtgcgacccgcaggctccgggttggacaagtttgttgtaaacaatgccatgatgccggcataaggtcgttaccagtattaggaaggttctcaggtttcctctagcccttgggctcttttcctgaagtgcgtgtgtcttctgctagattttgtgaccaatgttgattgcctaattgggctaacagcatgttttggtggctacgaaactgacacaggtgttttcatttctccacttagttcctgctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagggggaaggctgactaggacctctgattcttctttccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccaggcctcctgagagtgaaatgtttcattgtttgtctagagaaatgagaactaaagcttgcaccttgtgataagttgtcctgaggaacatatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaacatggtgaaaccccgtctctactaaaaaatatacaaaacattagccaggcatggtggtgggcgcctgtaatcccagctactccataggctgaggctggagaatcgcttgaacccaggaggcagaggttgcagtgagccgagattgcgccactgcactccagcctgggcaacaaaagcaaaactccatctcaaaaaaaaaaaaaaaaaaaaaaaaaaagatgcagacacgagactgtgaaactgactagcatcaccattgcattgtttatagatgttgccagacagaaagccccaaagcagcacagtaccttcctgacatctggactaggaaatctagattttagtaaaatacatgctaatacttacagaagaaatgtcggcgttagagtatgccgtcagttccttagagattgcaattcctaatgcactagtatggtttcaggtgccaggaacacgttctgtgaggctgctgccccaggtgctgaccccagccttccacaccattttccttccttgtgttcacagccgctctgtcttttacaatagcacccctctctagtggctaatgggctctatgattagatagcatccttcagtagtgataaaggcagtgacatcctagggaggtcagcgggtgaaagcgctatatctggaaaacctgagagcctgtgaagctcaaggacttgacggggttagaccgtgagccgggctgcagctggaaaaagaatgactgttctttcagcagatccttccctgtgccatctctttcttcattcctctctagtggcattcttatttatcctctaaaaccacaattccattatctctcctattcttatcaacactgccctaaatgatattctttattctcttttgccctggaaaacctctatcatgccttttcccatgtgattacctcgttaagagtgggggtggaatgtctagcaatgaaataagagggtcttctcttttgcctggctccctatgcagccctatcttaccccctgcaaagtcccagggatgtggctcagtcactgctcctctcttcatctgtcaccacttgcttgagatcctacagctgctttaattccgagaccatctgcagaacatgacaaaatttgtccacctacccacatgtccttttaactttaaaggctttactaactgattcctattagggaatgaacagaggtggcaaaaataaacaataggagattgatttacaagaaatctttaaaatagtagatttcttcggacctcattgaaatataaatggcctgccttcttgtgtccctccctggtctccctctttaggtgataagaagaagatcctgccagccccataacccgccatctgcgcgggttctagacccccttctcctcccctctggccgtggtaggcattactgatgaatcatggtgctctttcttccagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccgtctagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctagatgagatccttcccccggaatttctctcttgaaccccagatggtccgttgcccctttccagaagttgctccagccctgtccgcttaggaagttcagtgtcatccttgatccagtgggtagggaagacattccataatgaatgccccagtctgagcttcttccttcaggcttcaggctgccctgcgaggattttgcagctccctttttaatgccctctagaagtttctggctcttattttcagcccttcatcctactctctctgaccccttcctctatcctgtttagttcacctgtagcagttactacccagcagtgaaggatgaatcttggtttcgtttcttttctcttcttttcttttttctcttctcttttccccttcccttcccttccctcccttcacatcacctcatctcacctcaccttacatagtcttgctctgtcacccaaactggagtgcagtggcctgatcttggctcactgcaacctccacctcttcccaggttcaagtgattcttatacctcagcctcttgagtagctgagactacaggtgtgcactaccacacccagctaattttttgtatttttagtagagatagggtttagctatgttggccaggctggtctcgaactgctgaactcaagcaatctgccatccccggcctcccaaagtactgggagtataggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccatggagtcctgtcctctgttggggctcctactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctgtgccaggtaccaggtcagttgctgaaggagtaacagtgaacatgacggagtctttgtccccaaggagacccaaggtgtctcctagagccaggggcacattgcaagaccaaatatattcaacttaccaaaataatcatagacctagttctcaaaaagcaagaagactgattcctcgttgtcatttctcctcctcagcatcaatgttttagagtctgtgggcccctccaagtgtggagtatggtgttacttcaccagagtttgaggagaaacattcttcttttggaaggccggggagcatagatggatatcaaggctgctgtttctaaaagcgaaacccaccaaacaacagtattagaatcatctgtggtgcttattaaagatacagattcctgggccccatcccagacttatgaatcagaatctctgccagaggaagcctgagaatttgcattctcagatgattctgcattctcagataacacattctttaggtgattcttacacacactggagtttgggaatcgctgaaggctgttcacttctcttttctgagaaatgattcattcatttcagaaatatttgcagaggtccttatttattggagatttgtgggtgggcagaggagaaatatcttgtcctcacagagcttacaatttttattttctttagaggtcaccaggcttaaaatgacacttccctaaattctgaaaagaacagatttttaaaacaagaagggactgtaatgttttctgttcctacctcgtattttgttcacattaagaacctggggtgggaagtggaggagggggggtgactggcggggggccacagagagctgagctggggtggtctcgaactcctgaactcaagcaatctgccagcctcagtctcccaaagtgctgggattataggcatgagccacccacgatgcctgggtggaactcagggctctggatgcctgggcgcccccatctcccacactacggcgcctcatcctagaagtggttagcacctttgagatgggaattatttagcaggatgcttttgtgttttcatgtaagttttatgctgcctgtggagggcacagctgtttcaaaactaataaccaaatcctggtctccgaagtctgaaggcatcctttgccctgcagtgcaaagcacgggattctggcctcacacaggcaggtctgaactcctgtgttgcctcttgctggctgtgggacctgaggcaaatcatgcaacctctcttttctgtttgcctagatggaaaataggtttacaatacgcccccataggatggctgtgagaattaaaggaagtcatgggtgtacaatacctggccccgaaagatgcttaataatttaattctgaccttcctcactcatttaggattatgtaccaacttttagaaacaatgaaagattagtgagtcttctgtggttggtataaaaaaaaaatagaaacatgaaagagatgtcctccttgttcaagggctaatgaccctggtgtgcgctgtctaggcccccaaggtcttccttccctgctcacagcatttcaggttctccgcagctttgctgagcctgggtcaggttcggtatctgcccaccatgctcacttgccacagctgtggccccatttccaaacttcagagacttaaaggtgcagctaatgatgtgcccggcctggggtcacattccctgagccctgcagacaagggagcaggaggctgagctcttatcttccacaccctgtgcacagcctgggaagagttaaagcaccctagtcctatgctgcgagggccacatgccctgagaccttggaaaaaatcctacctgaattgaagagcatcactatttcatcaggaggcgctgccatttcatttttcacttcggttttatcttgagtgtaaaacagcttcgcaaatcactttttcttgtttctgtaatgagcatatggtggcctcattcgtgtgataaatctgagccaccacgatatttgacttttcacaatttaatttatctgaaccctctattctctggctaaaaaatatcccttacttggacttctttattttattttcaattcccttaccagcactagcaggggactctgtactcatctgctggcgctgccataacaaagcactgcagcctggggggctcaaaccacagaatttattctctcacagtcctagaggctagaagtccaagatcaaagtgtgggcagggtcggtttctcctgcagcctctctccttggcttatagagtgccaccttctacctgtgtcttcacatcatcacctcactgagcatgtctgtgtccaaatctccccttcttataagaccccagtcatactggatgaggatccacccatatgagttcattttaccttaattatctctttaaacaccctgtctccaaatacagtcccattctgaggaactgagagtaaagattcaacatatgaattttggaagggacctaattcagcccacaacaccctcttttgggatgtttattttcccccttaaggagctagttaggatgtcttatctcatgaacatgactgtgaacaggaaaacagggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggctgatgctgctggtccacggaccatactttgagtagcaaggagcttgatacataatggctgagtgactttcagactcctgctgtagaaaaattatgagttggctgggcgtggtggctcacgcctgtaatcccagcactttgggaggccgaggtgggcagatcacctgaggtcaggagttcgagaccagcctggccaacatggtgaaacaccatctctaccaaaaatacaaaaattagccaggtgtggtggcaggtgcctgtaatcccagctactcaggaggctgaggcaggagaatcgcttgaacccgggaggcagaggttgcagtgatctgagatcgtgccactgcactccagctgggcaatagagcttgactcagtctcaaaaaaaaaaaaagaaaagaaaaagaaaaattatgagttatattatcagcatatggggtgcctttcaaattgataaaatttctaatattaaacctgtggatgccaaatgctgctctctgattatggcaggaaacggcacttggcagtacgaagttagctgttgggctgagctggctcatcttgttgtgcggtcctgattgcctaaagatgccttcccaggatctttactaacaatcctcctgagtcatttggactttcccaacctgttatcacctctcagatgggccagccatggaggcagtcagaggagggctctgcagagggagggcagaaacagggtggcctctgcatgccattaggaggtcacatctcactgggggatgcagtttaggatttagtgccttggagagaaggatagagtatattaaaacatgtctccgctaggcatggtggtttacgcctataatcccagcactttgggaggccgaggtgagtggattgcctgagctcaggagttcaagaccagcctggctaacatgacgaaacctcatctctactaaaatacaaaaagttagctgggagtggtggcgtgcgcctgtagttgcagctacttgggaggctgaggcatgagaatcacttaagcccagaagactgaggttgcagtgagccgagattgcaccactgcactccagcttgggctacagagtgagactctatctcaaaaacaaagaaacaaacaacaacaataacaacaaaaaccaagtctctccctccactcaaaaatgcaagggcctgtctcccattgctgggtgcccaggtctcatgaatgtagatatgaattattccagtcagcctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcacttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctcttccagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctgatagttgaggggttttgttaatggcttttgggggatttatctctatacccacaaacgactagtttgttttcctcaaactaaatgataatattaaaaatacacatcctggccaggtgtggtggctcatacctgtaatcccagcactttgggaggccgaggcaggtggatcacttgaggtcaggaattaagaccagcctggccaatatggtgaaagcctgtctgtactaaaaatacaaaaattagccaggtatgctggtggatgcttataatcccagctacttgggaggttgaggcaggagaattgcttgaacccgggaggtagaggttgcagtgagccaagatcatgccactgcactccagcttgggcaacagagtgagactccatctcaaattaaaaaaaatacacatctggcttctggaaaaattacttgaagatcttttatgacatccatccctcttcacacagccatgtgaattaggttggtatcttcatatactagcatcgtgcccagcacttccatgttatacagtttaaaatgttctgtaattccctgtgggaacctaagataatgcgaggaccgtcatacgtgcccccaaatattggcaaaccaatgaataaatgaatgaatgagtttatgaatcgctaactggctgtatttaatgaagtatgtgtgttgagccatttcccacagtgtggacagatttgtcccacaatatgggcctcttcccaaaggccctaccacctaatgccatcacactggggatttgatttcaacatgtgaatttggggagagtgcaaacactcagaccatagcaccatctcagtaaatgtcccactggtcactcagttcatagtgacagtgatccagccactgtcatgacaggtgccacttggcagaaacagcacagcttggaagatggcggggtgtagtcaagattccaggatccccaacagagaagccagctcttataggggagccattcatcaggattgaactctcaatcgagctggacagtaataggtgggtctgtgttattccccagatgagtatcatgacagtcacaatcctaggaaggatgtgaagcctcccccagctctcctccagttgcctgcttgggcagcagagatgatggaatgtggagtctggcgtggtctgaggcctgaatccatgtgcctcatgtatgatgctcaggcaagaggatctctcaattcaagggagagggcctgaatgagccttgctttccaggcctgtctgatggtccaggctgaagcccctcctggcttgcactgccagacctcatccagcaggagctccttggcattgactgcttcaggatagttgcttctgctctgagtgctctctaaagagcagtgctctaccatccaagctgggcttttcttttcttcttgctgatagggaaggcatgggacattgcaggatggaagtggcccccaggccttctcatgcctgggcttggtttggaaggtggtcaggtgatcaataatcctgattggcctggcattgaggagttttcctgggatgtggtcctttcggttttttaaaaattatttttattgatacacatatttgtaggtatttgtggggtgcatgtgatactttattatgtgtgtggattgtgtaatgatgaagtcagggcatttagggtcttcatcaccttgattatcatttctatgtgttgagaacatttcaagttctcagttccagctattttgaaatagacagtccattttgttagctacagtcacccaacccggctgtcagacattggaacttactcctattgaactgtgtatttgtacccattcaccaaactctctttgggctttcagttttacaactgggatgatcctgggaaaactaaagtaaatcagacacccgacgtgtgagctaggttataatatgcccagtggaccctggggacatcttagctttcagaggtcatgctgtccaagctgactgtggggcttccagaaggtggggagaggaaatgatgcaatggcccatcagaggcactacttggggcctggggccagagtgcatgtctaaggcattaaggggaggggagagcagccttcataattatgaagaggagtctcaggtgcacagcttctgatgagggacagcttctaattgaagacagcattgtgtaatgctcaaactccctgtcttcagagtgcctgctgtatcccaccatcagttctgtgacttctccctaagcctcaattttgcatgtgttacattgggataataatagtgccaaactcatggggttgtgaggaataatgaggtaaagcaattgaaaaggtttagcacaatataagtgctcaataaaagccattattattattttattacactagttttcaattcctgcatagcaaattcttgcaaatgtagggactcaaaacaatataaatttattatctgacagtttttctgggtcagaggtcttactaggctgtaatcagagggcaaccaaagctgtgatctcagctgaagctcaggattctcttccaagctcactggttgttggcagaattcagttctttccagttggaagactaaagcctacagtcttcagtctctagaagccttttctctggcacaggtttctctacaacatggccatttatgtctttaaggccaataggagaacatgattagcatattttttttaagtgaactttagacccttttttaaaggcctatctgattaggccaggcccaagtgagctttaagtcaactgattagagatcttaattacatctgcaaagtcccttcatgtttaccgtataacataacttagtgaaaggagtgaaattgcaaccaggttctgcctgcactccacggaaggggattctgcagaagtgtgggtcacgggggggttattttgggattctgcctacgtcactgagtcaaaagaagctgaatggttgtgatgctgaggtttttgggcagcagcagtgtgtgtgtgtgagtgaattcatacgtatgaccacctgggaagaaaggaggctgtggtttcctccacctcctggcagacagagaaatttctttttttttttgagacagggtctggctctgttacccaggctggagtgcagtggcttgatctctgctcactggctcactgcagcctctgcctcccaggttcaagtaattcttgtgcctcaactccaagtagctgggattacagacacacactgccacgcctggctaatttttgtatttttagtagagacgaggttttgccatgttggccaggctggtcttgaactcctgacctcaagtgatccgcccacctcagcctcccaaagtgctgggattacagacgtgagccaccattaaccatttttctatctcctgtgggaaagggcacagtgaaagaacagatgaagctgagacatacaagtgaactcctccctcctctccatttagactaaaataggattattcatactgagattctccctggttgcaaagagataatctgtgcaactgggtttttacaattatccctaccctatgctttcctcatctgtcttcctcgtagtcagctcaggctgctataacaaaacaccataactgggggcttttgaacaacaaaactttacttctcacagttctagaggctggaaatccaagatcaagtttctggcagattcggtgtctaatgaggtcctgctttccagtttatagacagtgccttatcgctaccgccttacacagtggaaggagaggacgagaagctccttgggcttttttttgtttctttctttctctctctctctcttttttttttttttaataaggtcactatcttagtccattttgtgttgctaaaaggaacatctgaggttgagtaatttattttattttaaaaagtggccaggcatggaggcttatcctgtaaccctaatcctttaggaggccaaaacagcaggattgtttgaggccaggagttcaagaccagcctaggcaagatagtgagaccccatctaccccatctctactaaaattttaaaaaattagctgtgtgttgtaaagtgtgcttgtagtcccggccacttgagaggctgaggtgggtggagttcaaggctgcagtgagttatgattgagccactgcactccaacccgggtaacggggcaagaccttgtctctatttaaaaaaaaaaaatctttatgtggctcactattctgggtggctggaaagttcaagattgggcatctgcatctggtgacagcctcatgtcgcttccagtcatgggggaagacgaaggagagctggcacgtgcagatatcacgtgttgagggcagaagcgagagagagaggggagagatgccaggctctttttaacaaccagcactggggaaactaatagagtgagagctcactgactcctgagggaggacattaatctattgatgagcgacctgcctccatgacccaaacacctccaacgataccccacctccaacactgccacactagggattaactttcaacttgagatttagaggggggaaacttacaaactatcgcaggcactaataccactcatgagggctccaccttcatgacctaatcacttcctaaaggccttacctcttaatctcatcacattgaggattcgatttcaacttgaattttggggggacaccaacattcaggccatagcatcatctcaataactgtcccattggtggtcactcaggccccaaacaaaggaaccttcctccattcctttccgccctcccacccacagtcaatcatccccaagctccatcagctccacctttaacggccaacccacctctgccacatctcaccatctccactgctatccctgtcacctgggcccaccattctctctcctggacagtctccatagccacctctgtcagatttattttatttttttatttttttttttgagacaggttcctgctctgttgcccagactggagtgccatggcatgatcacatctcactgcggcctccatcacctgggctcaagcaatcctcccatctcagcctcccaagtagctgggactactggcaccaccatacctggctaattttttgttgttgttgtttaatttttaatacagatgaagcctcactatgttgcccaggctgctcttgaactcctgggctcaagtgatcctccggccttggcctcccaaagtgctgggattacaggcatgagccaccgtgcccagcccatcagatgttaatgctacacgcacttgcttaaaatcccccagataattctcgctgctcttggaataattcccacacaccttggcgtggccatgcaggctctgtgccatcggatatgtccctgccccctctcccaactcctcctttcgcttgctcgttcactcagttccagccacattgccctgggagctgctcccaccatggggcttcctaatgcactggtctctctcatgcagtggggcctctccctccttttactcagtgtctcccagcacccacctcctccagagccttccctgaccaccacacctacacctaggcccttcctcctccacgctccctcctccaccccggcctcctacccacgtgtcacttctttatactcgctgccacctgaaattagatcatttatttacccctttatttgttcagtttgccttgtccgttagaatataagcttccaaagggcaggagctttgcctatattgttaggccgggcatacaatgagcactcaaaaaaatatttgatgagtgtatgaaagaacagactgggttatgtaattgtgcctacttacctatatgaccgtgtggtggggtttatggtgggtgtggtggtgatggctatagggctataagcaaatttgggacagggagtctaagaaatgttcttaaattttagtaagcaaagcatcctctacagaacctgtcttaaaacatgaaagttccttagtgctacccccagaggtatgatttggtaggtcaaggatagggcctggaaattcacattcttgttaagatgttcttcatccggggtttgttgaccaccttttcagaagatttttgctctgtagctgtactacccaatgcagtagttcgtagtcagtgtggctcctgagcccttgaagtgtagctcctctgaactgagacgtgctgtaaatgtaaattgcacaccggagtttgaagagttaatacaaagaaaaaggaatgcaaaacatctcattaataatgctttacactgattacatattgaaatggtaatcttgtagatatagtgcgttaaataaaatatactgttaggcttaatttcacgtctttatacttttaatgtggctactagaaaaatttaaataacatattcagctcacattatactcctattgaacagagctgatctataagttccatggaagatggcaagtcttcgcagctgaaataaaggctggatcccattctacgggctcatctttagcaatgatttcttgcagacgatattgaaaaatgtggcaatgaaagttaccacaagcatcaaaccagtcctgcctaaatctggaaaatagttatctgaggctgttagcatatgatcatgagagcgtttcaccatggatttctgatcacagatgtggcacattattaaaatatcacttttacagtcaccctagaggctagggttatctgaatatggagaaagaaacagcttgtggagctgttgtataaatgaaattactagaaagtaatgcactcaattgcatattggctcggggggttattcttattaaaatgtttagagaggactttctgttcatttctgcagaattgctcttcaaattaagaatttgcttgacacgctaatagaccacagtcccaagagaagtttatccttttttcttcttatccttgctaagcacttagatgctctgctgataggtagcatatattgtctatatgaagcttttgtgttaacattgactagtcctgcaagttggcacactcttacttggcctaaaagaaatcagcaccaggctttaagaaaatcagatgatctacctaaaggaacacaactctgtctctcttttgacaattgttgtaaacaaattttaatggaaatttgccttaattgtgaagaagttgctgctaaaatggacttgccattaatggactggaacccattgcataagcagaatgaaatataagccttctcaggattcacacttataaaaaaccattcagccaatcaacaagagggcaaaagaacaaacatttgatgtgtaattacttaatttagtgcatatgcatttgggtcctcaatgtcagcactatggcaaccagaacatggccacaataactgtctggaaatgtctattcttacctggacccagcaggccatgccccactgattatataatctccctctctccttgttacggtctgaatgcttgcatccctcaaaaattcatgtgttgaaatcctaacccccaaggtgatgatattaggaggtcggccttttgagaggtaattaggtcatgaagacagcatcctcatgaatgggattagtgtccttataaaataggcccaagggagctcattcactttgtccaccatgtgagaacacagcgagagggcaccatttatgcaccaggaaatgggccttttccagacaatctgtcggtgcctggatcttggacttcacagcctctagaactgtgagaaattaatttgttttttataagccaccaaatctatggttttttttatagaaaccgtaatggactaaaacactccctaattatatttaaacttatcagtgcactgggcagtgacatattaaaagaatgctggccaacgtaattgacaccataaggctggatgattcttgtaattttcagcctcagaaaaaggctggggagaggagtcaggggaaaggaggtggtgtgtgtgtgtgtgtgtgtgtgtgtgtgtgtgtgtgtggtacggtggatgcctgctgagagagaaagagctataataacattctgtggttcagctgacacatcctttctgcatcccctccaatcacctgggttaatggggacctcgctaatgtctgaacctcatctcattttaaccttttgtttcaaagcctctcttttcatgacttccccgccttcatttttcccatatggtggggttattattaagacattaaatgagagtggacaggtaggcaaaggaggtgggttgcaggggagttgagggttgcctgtgtacttttctagactgttccacttcacatcagtgaaatattcccaattgatactatcatgaaacaaagcaaatgaaatgctgagcacggagcttcgtcttgatgaaatgctgaaagaaaagaaaggaaaaataaagtagccattatttttgcccttcctcccacccccatgtttactactcttatttctcttttgtattgttgtgttggaagcacagcatcagaaaaactcccagttttgagagataactcagtgtttagttcacttaaacctgagaaaggagaagaggatgccaccgtgaggtccaggacgtaaagaggaaaaaaacagacaaaaaaatccatatgaaatgaaaatgtgaaagaggcgctttcgagcagatgagtgttgtagattacagtgttgagagctgtttgtgtccagagctgcttgctgcacctggcgggataaacactggtctaacagaggatccttgtttcaaggaggctgccttttatttggggggacaaaattgttcttgaaagctgctcagtggttcaagctacagcatggtggactagcagaatggactccagggcctccgaggagacagtgactgctgccagaaatagtcaaggatagaaaggaaggacttcactgaggcctgggagaagattatggaatgggactgacagcagtgacggggagtaaaagggggtgtctgggggaattgtgccccatggtgagagctagagggttcacaaagacttaacccgacgcatctctctcaccctggagattgggcccgttcaatctaactggatggctataatttaaaaggtttaggtattatgacaaacatggatatattaggtgatagcaatgcaaaatgcatatggcttcttgatataaaacacaagacttgaaagcagcatctttggctgggtactacagccaccctcctctgtcactaagggaggctttggtggaaagggctgagagcctctagactgtgaacaaaagtaggcacagaagaacagttggagataataagtaaaccatcttgacaggaatgaagaatttcctgaaaggaaggtccctgagttaggttgttggatgctttcagtagtgagttattgaaagtgtttggggggtgtgtgtgtgtgtgtgtatgtgcagtatgtgtgtgt

SEQ ID NO: 2 - protein, 161 aa, Homo sapiens
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 3 - DNA, 873 bp, Homo sapiens
acttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgtttt

SEQ ID NO: 4 - DNA, 24 bp, Homo sapiens
cctttgctttgttcctatttcttt

SEQ ID NO: 5 - DNA, 20 bp, Homo sapiens
tcccattgcccagagttaat

SEQ ID NO: 6 - DNA, 23 bp, Homo sapiens
tcctcatgtcttcacctagaagc

SEQ ID NO: 7 - DNA, 20 bp, Homo sapiens
ccactcatgagggagctgtt

SEQ ID NO: 8 - DNA, 21 bp, Homo sapiens
tgtcacaggcacacactctct

SEQ ID NO: 9 - DNA, 20 bp, Homo sapiens
gagtatggctgctgctcctc

SEQ ID NO: 10 - DNA, 20 bp, Homo sapiens
atggctcacactggcctaaa

SEQ ID NO: 11 - DNA, 23 bp, Homo sapiens
tgaacagaccaataatagtgcag

SEQ ID NO: 12 - DNA, 20 bp, Homo sapiens
aagccaccctttaaacagca

SEQ ID NO: 13 - DNA, 20 bp, Homo sapiens
gctgaggaagcaactccact

SEQ ID NO: 14 - DNA, 20 bp, Homo sapiens
gctctgaattccctggcata

SEQ ID NO: 15 - DNA, 21 bp, Homo sapiens
ttagccctagtcccactctcc

SEQ ID NO: 16 - DNA, 20 bp, Homo sapiens
caagaggcctgcataaggaa

SEQ ID NO: 17 - DNA, 20 bp, Homo sapiens
agattgccggtggcttaaat

SEQ ID NO: 18 - DNA, 20 bp, Homo sapiens
tgtctgttcccgtctgtctg

SEQ ID NO: 19 - DNA, 20 bp, Homo sapiens
ttcatcctctgccaaattcc

SEQ ID NO: 20 - DNA, 20 bp, Homo sapiens
ggcatgtattcactgcctga

SEQ ID NO: 21 - DNA, 23 bp, Homo sapiens
aaacccattcttcttcctcttac

SEQ ID NO: 22 - DNA, 21 bp, Homo sapiens
tatgtgttcagcccagacctc

SEQ ID NO: 23 - DNA, 19 bp, Homo sapiens
ccctgccatgtgcatttac

SEQ ID NO: 24 - DNA, 20 bp, Homo sapiens
catttcggaaggcaaagaaa

SEQ ID NO: 25 - DNA, 20 bp, Homo sapiens
ttgcaatgaggaatgaagca

SEQ ID NO: 26 - DNA, 23 bp, Homo sapiens
tccattatccatctgttcattca

SEQ ID NO: 27 - DNA, 25 bp, Homo sapiens
gaagaattaattgtaggaggcaaga

SEQ ID NO: 28 - DNA, 21 bp, Homo sapiens
ctgacatcaccacattgatcg

SEQ ID NO: 29 - DNA, 22 bp, Homo sapiens
catacacagccatgtggaatta

SEQ ID NO: 30 - DNA, 20 bp, Homo sapiens
acggtgatgacgcctacatt

SEQ ID NO: 31 - DNA, 23 bp, Homo sapiens
tcacatggaccaattacctagaa

SEQ ID NO: 32 - DNA, 25 bp, Homo sapiens
aaattacttcatcttgacgataaca

SEQ ID NO: 33 - DNA, 20 bp, Homo sapiens
ctattggggactgcagagag

SEQ ID NO: 34 - DNA, 20 bp, Homo sapiens
agccagtgtccacaaggaag

SEQ ID NO: 35 - DNA, 21 bp, Homo sapiens
gagggtgagacacatctctgg

SEQ ID NO: 36 - DNA, 20 bp, Homo sapiens
aatcgtgcctcagttccatc

SEQ ID NO: 37 - DNA, 20 bp, Homo sapiens
ccaccaggaacaacacacac

SEQ ID NO: 38 - DNA, 18 bp, Homo sapiens
ttgctctccagcctgggc

SEQ ID NO: 39 - DNA, 18 bp, Homo sapiens
ttcctctggctgcctgcg

SEQ ID NO: 40 - DNA, 20 bp, Homo sapiens
tcctgcatgagaaggaactg

SEQ ID NO: 41 - DNA, 20 bp, Homo sapiens
cgacattcactgtggctctt

SEQ ID NO: 42 - DNA, 20 bp, Homo sapiens
tttgattccgtggtccatta

SEQ ID NO: 43 - DNA, 21 bp, Homo sapiens
ttatttggtcggtgcaccttt

SEQ ID NO: 44 - DNA, 20 bp, Homo sapiens
ggtgcaccgaccaaataagt

SEQ ID NO: 45 - DNA, 22 bp, Homo sapiens
ccagcttattctctctgccttc

SEQ ID NO: 46 - DNA, 22 bp, Homo sapiens
ggtaggttgaaatgggctaaca

SEQ ID NO: 47 - DNA, 21 bp, Homo sapiens
tcatgacaaggtgttggattt

SEQ ID NO: 48 - DNA, 20 bp, Homo sapiens
cctcctctgccatgaagcta

SEQ ID NO: 49 - DNA, 20 bp, Homo sapiens
ctatttggtctgcgggttgt

SEQ ID NO: 50 - DNA, 20 bp, Homo sapiens
tactgggttatcgcctgacc

SEQ ID NO: 51 - DNA, 20 bp, Homo sapiens
ccaatggacctcttggacat

SEQ ID NO: 52 - DNA, 20 bp, Homo sapiens
tttcggcacagtcctcaata

SEQ ID NO: 53 - DNA, 19 bp, Homo sapiens
cagctgggtgtggtgacat

SEQ ID NO: 54 - DNA, 20 bp, Homo sapiens
cagagaggaacaggcagagg

SEQ ID NO: 55 - DNA, 20 bp, Homo sapiens
agtggctgggaagccttatt

SEQ ID NO: 56 - DNA, 23 bp, Homo sapiens
aggtgagagaacaaacctgtctt

SEQ ID NO: 57 - DNA, 20 bp, Homo sapiens
gccttccttctaaggccaac

SEQ ID NO: 58 - DNA, 26 bp, Homo sapiens
ctgtagactttatccctgacttactg

SEQ ID NO: 59 - DNA, 24 bp, Homo sapiens
caatgaatgatgaagattccactc

SEQ ID NO: 60 - DNA, 23 bp, Homo sapiens
tgacaccatgtcttactgtttgc

SEQ ID NO: 61 - DNA, 25 bp, Homo sapiens
gaggatacaatgagaaccaaatctc

SEQ ID NO: 62 - DNA, 20 bp, Homo sapiens
caggatcatcagccaggttt

SEQ ID NO: 63 - DNA, 20 bp, Homo sapiens
gctgcatgtcactaggcatt

SEQ ID NO: 64 - DNA, 20 bp, Homo sapiens
ccacagaatgctccaaaggt

SEQ ID NO: 65 - DNA, 22 bp, Homo sapiens
gagttcaagtgatggatgacga

SEQ ID NO: 66 - DNA, 24 bp, Homo sapiens
cagatagatgaataggtggatgga

SEQ ID NO: 67 - DNA, 20 bp, Homo sapiens
cactgttccaagtgctttgc

SEQ ID NO: 68 - DNA, 20 bp, Homo sapiens
tatgcgttgtgtgtgctgtg

SEQ ID NO: 69 - DNA, 22 bp, Homo sapiens
gggccttagattcttgtagtgg

SEQ ID NO: 70 - DNA, 20 bp, Homo sapiens
tgtccagactgcctcctaca

SEQ ID NO: 71 - DNA, 20 bp, Homo sapiens
tgcaacacctggttcacaat

SEQ ID NO: 72 - DNA, 20 bp, Homo sapiens
tttgcgagtccttgtggagt

SEQ ID NO: 73 - DNA, 20 bp, Homo sapiens
acagtccgctccctcctaat

SEQ ID NO: 74 - DNA, 18 bp, Homo sapiens
atgcttggccctcagttt

SEQ ID NO: 75 - DNA, 21 bp, Homo sapiens
ttggcaacccaagctaatatg

SEQ ID NO: 76 - DNA, 19 bp, Homo sapiens
ctccacagtgacagtgagg

SEQ ID NO: 77 - DNA, 17 bp, Homo sapiens
gagaggttcccaatccc

SEQ ID NO: 78 - DNA, 20 bp, Homo sapiens
cagctcctggccatatttct

SEQ ID NO: 79 - DNA, 20 bp, Homo sapiens
gagccatttctctgggtctg

SEQ ID NO: 80 - DNA, 20 bp, Homo sapiens
ggtccgtgtcaacccttaga

SEQ ID NO: 81 - DNA, 19 bp, Homo sapiens
caggttgatgggagggaaa

SEQ ID NO: 82 - DNA, 20 bp, Homo sapiens
cgggaaatgacagtgagacc

SEQ ID NO: 83 - DNA, 20 bp, Homo sapiens
tgcctagattctcccgtaag

SEQ ID NO: 84 - DNA, 16 bp, Homo sapiens
gtgcccagccagattc

SEQ ID NO: 85 - DNA, 16 bp, Homo sapiens
gcccccagtcaggttt

SEQ ID NO: 86 - DNA, 21 bp, Homo sapiens
tttctctctccacggaatgaa

SEQ ID NO: 87 - DNA, 21 bp, Homo sapiens
aacccattctcacagggtgta

SEQ ID NO: 88 - DNA, 20 bp, Homo sapiens
aggagtgtggcagctttgag

SEQ ID NO: 89 - DNA, 20 bp, Homo sapiens
tggattcccgtgagtaccag

SEQ ID NO: 90 - DNA, 17 bp, Homo sapiens
atgctgggatcacaggc

SEQ ID NO: 91 - DNA, 19 bp, Homo sapiens
aacctggtggacttttgct

SEQ ID NO: 92 - DNA, 20 bp, Homo sapiens
agcatttccaatggtgcttt

SEQ ID NO: 93 - DNA, 21 bp, Homo sapiens
catgttgatatgcctgaagga

SEQ ID NO: 94 - DNA, 20 bp, Homo sapiens
cactgtctgctgccactcat

SEQ ID NO: 95 - DNA, 27 bp, Homo sapiens
agagattatgtgatgtaccctctctat

SEQ ID NO: 96 - DNA, 20 bp, Homo sapiens
tgatgaagatctgggcgtta

SEQ ID NO: 97 - DNA, 20 bp, Homo sapiens
tgcctgtgctcactcactct

SEQ ID NO: 98 - DNA, 22 bp, Homo sapiens
atgacctagaaatgatactggc

SEQ ID NO: 99 - DNA, 20 bp, Homo sapiens
cagacaccacaacacacatt

SEQ ID NO: 100 - DNA, 20 bp, Homo sapiens
tggtttaaaaacctcatgcc

SEQ ID NO: 101 - DNA, 25 bp, Homo sapiens
atcccaaactctgtacttatgtagg

SEQ ID NO: 102 - DNA, 20 bp, Homo sapiens
ccttggctgttgtgactggt

SEQ ID NO: 103 - DNA, 20 bp, Homo sapiens
cactcaggtgggaggatcac

SEQ ID NO: 104 - DNA, 20 bp, Homo sapiens
cactttgccagtagccttga

SEQ ID NO: 105 - DNA, 21 bp, Homo sapiens
ttgggaaagttaacccagaga

SEQ ID NO: 106 - DNA, 20 bp, Homo sapiens
tttgggaagagccatgagac

SEQ ID NO: 107 - DNA, 20 bp, Homo sapiens
ctctgggcattggaggatta

SEQ ID NO: 108 - DNA, 20 bp, Homo sapiens
gggagacaagtcaggtgagg

SEQ ID NO: 109 - DNA, 26 bp, Homo sapiens
ctgagtatggagtcttcatcattatc

SEQ ID NO: 110 - DNA, 22 bp, Homo sapiens
tgctactagatttgaccaacca

SEQ ID NO: 111 - DNA, 26 bp, Homo sapiens
gacttgtaaaggatttagtgatttcg

SEQ ID NO: 112 - DNA, 20 bp, Homo sapiens
gtggaaggcctctctctgtg

SEQ ID NO: 113 - DNA, 20 bp, Homo sapiens
tgcttcttgagggaaagcat

SEQ ID NO: 114 - DNA, 21 bp, Homo sapiens
ccttcagaggatttccctttc

SEQ ID NO: 115 - DNA, 20 bp, Homo sapiens
ctggtttgactccagcttca

SEQ ID NO: 116 - DNA, 20 bp, Homo sapiens
cctggcacggaatagacact

SEQ ID NO: 117 - DNA, 19 bp, Homo sapiens
ggcctcctttgctctgaag

SEQ ID NO: 118 - DNA, 21 bp, Homo sapiens
catccctgtggctgattaaga

SEQ ID NO: 119 - DNA, 20 bp, Homo sapiens
aacagttccagcccgttcta

SEQ ID NO: 120 - DNA, 22 bp, Homo sapiens
tttcaaaggaatatccaagtgc

SEQ ID NO: 121 - DNA, 24 bp, Homo sapiens
tggcgtaccatataaacagttctc

SEQ ID NO: 122 - DNA, 20 bp, Homo sapiens
ttcaatgaaggtgccgaagt

SEQ ID NO: 123 - DNA, 20 bp, Homo sapiens
tgtctatcccaaagctgcaa

SEQ ID NO: 124 - DNA, 21 bp, Homo sapiens
gctcagtccaagttcatgctc

SEQ ID NO: 125 - DNA, 20 bp, Homo sapiens
tgggattgggttctggatac

SEQ ID NO: 126 - DNA, 22 bp, Homo sapiens
cctactttccatctcctccttg

SEQ ID NO: 127 - DNA, 24 bp, Homo sapiens
tggagtaagttggagaattgttga

SEQ ID NO: 128 - DNA, 24 bp, Homo sapiens
gcaagactctgttgaagaagaaga

SEQ ID NO: 129 - DNA, 21 bp, Homo sapiens
tccctctgtttgagtttctcg

SEQ ID NO: 130 - DNA, 20 bp, Homo sapiens
ccttgggcagtcagagaaac

SEQ ID NO: 131 - DNA, 20 bp, Homo sapiens
cccgtgaagtctgagaggtg

SEQ ID NO: 132 - DNA, 19 bp, Homo sapiens
aggcacagtcgctcatgtc

SEQ ID NO: 133 - DNA, 24 bp, Homo sapiens
aaactttagctaatggtggtcaaa

SEQ ID NO: 134 - DNA, 25 bp, Homo sapiens
gagcatgtgtgactttcatattcag

SEQ ID NO: 135 - DNA, 22 bp, Homo sapiens
agtggctattcattgctacagg

SEQ ID NO: 136 - DNA, 20 bp, Homo sapiens
ttgctggatgctggtttcta

SEQ ID NO: 137 - DNA, 27 bp, Homo sapiens
aaagagagagagaaagagaaagaaaga

SEQ ID NO: 138 - DNA, 22 bp, Homo sapiens
aaagtggatgcagttgaggttt

SEQ ID NO: 139 - DNA, 22 bp, Homo sapiens
gctagccattacagacaaccaa

SEQ ID NO: 140 - DNA, 21 bp, Homo sapiens
cagggctccatgtatccataa

SEQ ID NO: 141 - DNA, 20 bp, Homo sapiens
caatctttggctttgggttt

SEQ ID NO: 142 - DNA, 16 bp, Homo sapiens
ctggttgagcggcatt

SEQ ID NO: 143 - DNA, 16 bp, Homo sapiens
tgcagcctggatgaca

SEQ ID NO: 144 - DNA, 22 bp, Homo sapiens
cctatggaagcatagggaagaa

SEQ ID NO: 145 - DNA, 21 bp, Homo sapiens
cccacttctgagtctcctgat

SEQ ID NO: 146 - DNA, 20 bp, Homo sapiens
gggaaatggagctgctgtta

SEQ ID NO: 147 - DNA, 20 bp, Homo sapiens
gagtgggtgagtgcaaggat

SEQ ID NO: 148 - DNA, 17 bp, Homo sapiens
ctctcagcaggcatcca

SEQ ID NO: 149 - DNA, 19 bp, Homo sapiens
gccaacgtaattgacacca

SEQ ID NO: 150 - DNA, 21 bp, Homo sapiens
tgaaaggaaggtccctgagtt

SEQ ID NO: 151 - DNA, 21 bp, Homo sapiens
ccctgctttgcacaagttatc

SEQ ID NO: 152 - DNA, 20 bp, Homo sapiens
cacatgaggctgtatgtgga

SEQ ID NO: 153 - DNA, 20 bp, Homo sapiens
tgtgcaggaatgagaagtcg

SEQ ID NO: 154 - DNA, 18 bp, Homo sapiens
ccttaggccccataatct

SEQ ID NO: 155 - DNA, 21 bp, Homo sapiens
caaattcctcaattgcaaaat

SEQ ID NO: 156 - DNA, 20 bp, Homo sapiens
ggtcattcagggagccattc

SEQ ID NO: 157 - DNA, 25 bp, Homo sapiens
ccattatatttcaccaagaggctgc

SEQ ID NO: 158 - DNA, 20 bp, Homo sapiens
agtcaaggctgacagggaag

SEQ ID NO: 159 - DNA, 20 bp, Homo sapiens
gctctcagccctcaatgtgt

SEQ ID NO: 160 - DNA, 20 bp, Homo sapiens
atttgggttcctctcccaat

SEQ ID NO: 161 - DNA, 20 bp, Homo sapiens
acaaactcttgctgctggtg

SEQ ID NO: 162 - DNA, 20 bp, Homo sapiens
tgcctggtcatctacccatt

SEQ ID NO: 163 - DNA, 20 bp, Homo sapiens
tctactgcagcgctgatctt

SEQ ID NO: 164 - DNA, 20 bp, Homo sapiens
tccttccagaaggtttgcat

SEQ ID NO: 165 - DNA, 23 bp, Homo sapiens
tgcaaagttgttcaagagagaca

SEQ ID NO: 166 - DNA, 20 bp, Homo sapiens
cagcaggaagatggacaggt

SEQ ID NO: 167 - DNA, 21 bp, Homo sapiens
cacactgcatcacacataccc

SEQ ID NO: 168 - DNA, 18 bp, Homo sapiens
tatgccagtatgcctgct

SEQ ID NO: 169 - DNA, 19 bp, Homo sapiens
gtcacatcagtccatttgc

SEQ ID NO: 170 - DNA, 23 bp, Homo sapiens
ggtttatgtctgtgtgtgtgtgc

SEQ ID NO: 171 - DNA, 23 bp, Homo sapiens
tgagggatgtcagagaaatatgc

SEQ ID NO: 172 - DNA, 22 bp, Homo sapiens
tgatgaaattgcctagtgatgc

SEQ ID NO: 173 - DNA, 20 bp, Homo sapiens
ggatccaatcgtacgctacc

SEQ ID NO: 174 - DNA, 20 bp, Homo sapiens
acctaaacaccacggactgg

SEQ ID NO: 175 - DNA, 22 bp, Homo sapiens
caggtatcgacattcttccaaa

SEQ ID NO: 176 - DNA, 26 bp, Homo sapiens
ggtgatctagggaattatttgtcttc

SEQ ID NO: 177 - DNA, 20 bp, Homo sapiens
ttggccactaaggtccagat

SEQ ID NO: 178 - DNA, 20 bp, Homo sapiens
cctttgaggctggatctgtt

SEQ ID NO: 179 - DNA, 23 bp, Homo sapiens
tttccttatcattcattccctca

SEQ ID NO: 180 - DNA, 22 bp, Homo sapiens
agatattgtctccgttccatga

SEQ ID NO: 181 - DNA, 22 bp, Homo sapiens
cccagatataaggacctggcta

SEQ ID NO: 182 - DNA, 23 bp, Homo sapiens
tttaagccctgtggaatgtattt

SEQ ID NO: 183 - DNA, 21 bp, Homo sapiens
gacattgcaggtcaagtaggg

SEQ ID NO: 184 - DNA, 20 bp, Homo sapiens
tgcataaggctggagacaga

SEQ ID NO: 185 - DNA, 19 bp, Homo sapiens
cacagcagatgggagcaaa

SEQ ID NO: 186 - DNA, 21 bp, Homo sapiens
agccagttgtctttcatcctg

SEQ ID NO: 187 - DNA, 23 bp, Homo sapiens
tgcctgtgcttgtatattctgtg

SEQ ID NO: 188 - DNA, 20 bp, Homo sapiens
gtgcatgtgcataccagacc

SEQ ID NO: 189 - DNA, 20 bp, Homo sapiens
ggcaagatgacctctggaaa

SEQ ID NO: 190 - DNA, 22 bp, Homo sapiens
tttgtgttccaggtgagaattg

SEQ ID NO: 191 - DNA, 20 bp, Homo sapiens
gaaccatatcccaaggcact

SEQ ID NO: 192 - DNA, 22 bp, Homo sapiens
ttgttcccacattcattctaca

SEQ ID NO: 193 - DNA, 20 bp, Homo sapiens
ttaaactcgtggcaaagacg

SEQ ID NO: 194 - DNA, 18 bp, Homo sapiens
caccatgcctggctcttt

SEQ ID NO: 195 - DNA, 22 bp, Homo sapiens
aacttctccagttgtgtggttg

SEQ ID NO: 196 - DNA, 20 bp, Homo sapiens
cctaccattgacactctcag

SEQ ID NO: 197 - DNA, 16 bp, Homo sapiens
tagggccatccattct

SEQ ID NO: 198 - DNA, 25 bp, Homo sapiens
tctgtgtgtattgtgtactcctctg

SEQ ID NO: 199 - DNA, 22 bp, Homo sapiens
tcacacaatttgaaccaatcct

SEQ ID NO: 200 - DNA, 20 bp, Homo sapiens
accaagatatgaaggccaaa

SEQ ID NO: 201 - DNA, 22 bp, Homo sapiens
cctccagctagaacaatgtgaa

SEQ ID NO: 202 - DNA, 21 bp, Homo sapiens
tgatcatgtcagcagcagaag

SEQ ID NO: 203 - DNA, 20 bp, Homo sapiens
agtaacaggtgagggcatgg

SEQ ID NO: 204 - DNA, 21 bp, Homo sapiens
tgtccatagctgtagccctgt

SEQ ID NO: 205 - DNA, 20 bp, Homo sapiens
ctcaatgggcatctttaggc

SEQ ID NO: 206 - DNA, 22 bp, Homo sapiens
caaacaaacaaacaagcaaacc

SEQ ID NO: 207 - DNA, 21 bp, Homo sapiens
tggacgtttctttcagtgagg

SEQ ID NO: 208 - DNA, 23 bp, Homo sapiens
tgataacttaccagcatgtgagc

SEQ ID NO: 209 - DNA, 21 bp, Homo sapiens
tcacctcacctaaggatctgc

SEQ ID NO: 210 - DNA, 23 bp, Homo sapiens
gctagcaaatctctcaacttcca

SEQ ID NO: 211 - DNA, 20 bp, Homo sapiens
tcttctccatgctgcttcct

SEQ ID NO: 212 - DNA, 20 bp, Homo sapiens
catgcaattgcccaatagag

SEQ ID NO: 213 - DNA, 22 bp, Homo sapiens
ttgggcttgtctacctagttca

SEQ ID NO: 214 - DNA, 20 bp, Homo sapiens
gctgcacgtatttgttggtg

SEQ ID NO: 215 - DNA, 20 bp, Homo sapiens
aaacagcagaaatgggaacc

SEQ ID NO: 216 - DNA, 20 bp, Homo sapiens
ccgtgggctatcaatttctg

SEQ ID NO: 217 - DNA, 21 bp, Homo sapiens
aagatgcaatctggtttccaa

SEQ ID NO: 218 - DNA, 20 bp, Homo sapiens
cccaagactgaggaggtcaa

SEQ ID NO: 219 - DNA, 20 bp, Homo sapiens
gctgacggagaggaaagaga

SEQ ID NO: 220 - DNA, 20 bp, Homo sapiens
tcacaaagcaagcaatcaca

SEQ ID NO: 221 - DNA, 20 bp, Homo sapiens
tgatggatgcaccatgttta

SEQ ID NO: 222 - DNA, 20 bp, Homo sapiens
tgagaagcctgggcattaag

SEQ ID NO: 223 - DNA, 20 bp, Homo sapiens
acaagctcatccagggaaag

SEQ ID NO: 224 - DNA, 19 bp, Homo sapiens
agagctgatctggccgaag

SEQ ID NO: 225 - DNA, 21 bp, Homo sapiens
ggtggacacagaatccacact

SEQ ID NO: 226 - DNA, 18 bp, Homo sapiens
ggcctgaaaggtatcctc

SEQ ID NO: 227 - DNA, 18 bp, Homo sapiens
tcccaccataagcacaag

SEQ ID NO: 228 - DNA, 22 bp, Homo sapiens
tcaacctaggattggcattaca

SEQ ID NO: 229 - DNA, 21 bp, Homo sapiens
tctaggatttgtgcctttcca

SEQ ID NO: 230 - DNA, 20 bp, Homo sapiens
attcgtgcagctgtttctgc

SEQ ID NO: 231 - DNA, 22 bp, Homo sapiens
gcatgacattgtaaatggagga

SEQ ID NO: 232 - DNA, 20 bp, Homo sapiens
ggtgggaatgtgtgactgaa

SEQ ID NO: 233 - DNA, 22 bp, Homo sapiens
ccaggtacaacattctcctgat

SEQ ID NO: 234 - DNA, 16 bp, Homo sapiens
tgcaggtgggagtcaa

SEQ ID NO: 235 - DNA, 24 bp, Homo sapiens
aaataacaagaagtgaccttccta

SEQ ID NO: 236 - DNA, 21 bp, Homo sapiens
aaaggatgcattcggttagag

SEQ ID NO: 237 - DNA, 20 bp, Homo sapiens
actgtcctgtgcctgtgctt

SEQ ID NO: 238 - DNA, 20 bp, Homo sapiens
gtccacctaatggctcattc

SEQ ID NO: 239 - DNA, 21 bp, Homo sapiens
caagaagcactcatgtttgtg

SEQ ID NO: 240 - DNA, 19 bp, Homo sapiens
agcctgtgattggctgaga

SEQ ID NO: 241 - DNA, 20 bp, Homo sapiens
ggcttacagctgcctccttt

SEQ ID NO: 242 - DNA, 21 bp, Homo sapiens
cccacagagcactttgttaga

SEQ ID NO: 243 - DNA, 21 bp, Homo sapiens
gcctcccttaagctgttatgc

SEQ ID NO: 244 - DNA, 23 bp, Homo sapiens
cactctttactgccaatcactcc

SEQ ID NO: 245 - DNA, 19 bp, Homo sapiens
gccgtgtgggtgtatgaat

SEQ ID NO: 246 - DNA, 22 bp, Homo sapiens
ttgtaccaggaaccaaagacaa

SEQ ID NO: 247 - DNA, 20 bp, Homo sapiens
cacagacagaggcacattga

SEQ ID NO: 248 - DNA, 20 bp, Homo sapiens
gctctggtcactcctgctgt

SEQ ID NO: 249 - DNA, 19 bp, Homo sapiens
catgcctggctgattgttt

SEQ ID NO: 250 - DNA, 16 bp, Homo sapiens
ccaacatcgggaactg

SEQ ID NO: 251 - DNA, 21 bp, Homo sapiens
tgcattctttaagtccatgtc

SEQ ID NO: 252 - DNA, 21 bp, Homo sapiens
cagcaactgacaactcatcca

SEQ ID NO: 253 - DNA, 20 bp, Homo sapiens
cctcaatcctcagctccaac

SEQ ID NO: 254 - DNA, 21 bp, Homo sapiens
tgattggttctgttgttgctg

SEQ ID NO: 255 - DNA, 19 bp, Homo sapiens
agcccaaggctcttgtgag

SEQ ID NO: 256 - DNA, 21 bp, Homo sapiens
tccttcacagcttcaaactca

SEQ ID NO: 257 - DNA, 22 bp, Homo sapiens
agtgagaagcttccatactggt

SEQ ID NO: 258 - DNA, 20 bp, Homo sapiens
gccaaccgttagacaaatga

SEQ ID NO: 259 - DNA, 21 bp, Homo sapiens
ctacatgtgcaccacaacacc

SEQ ID NO: 260 - DNA, 19 bp, Homo sapiens
agtttattgccgccgagag

SEQ ID NO: 261 - DNA, 19 bp, Homo sapiens
acccaccacattcacaagc

SEQ ID NO: 262 - DNA, 20 bp, Homo sapiens
cgattgccatgtctctttga

SEQ ID NO: 263 - DNA, 20 bp, Homo sapiens
gagatctggcctggatttgt

SEQ ID NO: 264 - DNA, 23 bp, Homo sapiens
tcattgtcagcacagaatgaact

SEQ ID NO: 265 - DNA, 20 bp, Homo sapiens
ggagggagggaagaaagaga

SEQ ID NO: 266 - DNA, 22 bp, Homo sapiens
gggaagaggagattgacttgtt

SEQ ID NO: 267 - DNA, 20 bp, Homo sapiens
ggaacaccatcattccaacc

SEQ ID NO: 268 - DNA, 20 bp, Homo sapiens
tacaagctccaccgtccttc

SEQ ID NO: 269 - DNA, 20 bp, Homo sapiens
tgagttgctgcctcttcaaa

SEQ ID NO: 270 - DNA, 20 bp, Homo sapiens
tgctaatgggccaaggaata

SEQ ID NO: 271 - DNA, 23 bp, Homo sapiens
gctaaatgtcctcatgaatagcc

SEQ ID NO: 272 - DNA, 20 bp, Homo sapiens
tgtcctgcagacagatggtc

SEQ ID NO: 273 - DNA, 20 bp, Homo sapiens
cctccggagtagctggatta

SEQ ID NO: 274 - DNA, 20 bp, Homo sapiens
gagactggccctcattcttg

SEQ ID NO: 275 - DNA, 25 bp, Homo sapiens
aagaagccagagacaaagaaataca

SEQ ID NO: 276 - DNA, 24 bp, Homo sapiens
catctatctttggattcagtggtg

SEQ ID NO: 277 - DNA, 20 bp, Homo sapiens
tgctcccaacatcttaccag

SEQ ID NO: 278 - DNA, 23 bp, Homo sapiens
tgtcctctggtcatttctatggt

SEQ ID NO: 279 - DNA, 23 bp, Homo sapiens
catgaatgagaagtgatgaatgg

SEQ ID NO: 280 - DNA, 22 bp, Homo sapiens
cagacactgtaaactggcttcg

SEQ ID NO: 281 - DNA, 20 bp, Homo sapiens
gccacattgctatcagcgta

SEQ ID NO: 282 - DNA, 20 bp, Homo sapiens
atgtgctgtggtccagattt

SEQ ID NO: 283 - DNA, 25 bp, Homo sapiens
cctactactgcaattactccctacc

SEQ ID NO: 284 - DNA, 21 bp, Homo sapiens
tgtcataggcttgcggtattt

SEQ ID NO: 285 - DNA, 20 bp, Homo sapiens
ttggtagggtcctttccttt

SEQ ID NO: 286 - DNA, 20 bp, Homo sapiens
gcctgctcactgttgtttga

SEQ ID NO: 287 - DNA, 21 bp, Homo sapiens
cggttatcagagactggtggt

SEQ ID NO: 288 - DNA, 21 bp, Homo sapiens
ggcttatttcatgtacggcta

SEQ ID NO: 289 - DNA, 26 bp, Homo sapiens
ggttaaactctacttagtcctgatgc

SEQ ID NO: 290 - DNA, 20 bp, Homo sapiens
gaactctgcaggcacctctt

SEQ ID NO: 291 - DNA, 20 bp, Homo sapiens
cctgaagcgcttgtactgaa

SEQ ID NO: 292 - DNA, 20 bp, Homo sapiens
ttggcttctcgctctttctt

SEQ ID NO: 293 - DNA, 20 bp, Homo sapiens
agccatcagtcacatgcaaa

SEQ ID NO: 294 - DNA, 20 bp, Homo sapiens
agatctccagggcagaggac

SEQ ID NO: 295 - DNA, 20 bp, Homo sapiens
ccttcctccctccttctctc

SEQ ID NO: 296 - DNA, 22 bp, Homo sapiens
cagtcaaatgtctcaaccttcc

SEQ ID NO: 297 - DNA, 20 bp, Homo sapiens
ctagcaacatggccaagaaa

SEQ ID NO: 298 - DNA, 21 bp, Homo sapiens
cgtcattgatcccaatcatct

SEQ ID NO: 299 - DNA, 20 bp, Homo sapiens
ggctgatagcctcccttgta

SEQ ID NO: 300 - DNA, 20 bp, Homo sapiens
acctttcaagcttccggttt

SEQ ID NO: 301 - DNA, 20 bp, Homo sapiens
ttccatccgtccatctatcc

SEQ ID NO: 302 - DNA, 23 bp, Homo sapiens
ttaaagtcacttgtctgtggtca

SEQ ID NO: 303 - DNA, 27 bp, Homo sapiens
tttgtaggaatcaagtcaaataatgta

SEQ ID NO: 304 - DNA, 20 bp, Homo sapiens
ctttcggaagcttgagccta

SEQ ID NO: 305 - DNA, 20 bp, Homo sapiens
cccaagaccactgccatatt

SEQ ID NO: 306 - DNA, 22 bp, Homo sapiens
tgacaggtttgggtatattgga

SEQ ID NO: 307 - DNA, 20 bp, Homo sapiens
tgcttaatgtagtggcagca

SEQ ID NO: 308 - DNA, 20 bp, Homo sapiens
tcctgcctttgtgaattcct

SEQ ID NO: 309 - DNA, 20 bp, Homo sapiens
gttgaatgaggtgggcatta

SEQ ID NO: 310 - DNA, 22 bp, Homo sapiens
ttgggaataaatcaggtgttga

SEQ ID NO: 311 - DNA, 20 bp, Homo sapiens
gcagcagctcagcatttctc

SEQ ID NO: 312 - DNA, 21 bp, Homo sapiens
ccatttaatcctccagccatt

SEQ ID NO: 313 - DNA, 20 bp, Homo sapiens
gctccaccttgttaccctga

SEQ ID NO: 314 - DNA, 20 bp, Homo sapiens
acaaccctggaatctggact

SEQ ID NO: 315 - DNA, 22 bp, Homo sapiens
gaaggaaaggaaaggaaagaaa

SEQ ID NO: 316 - DNA, 23 bp, Homo sapiens
tgacaagactgaaacttcatcag

SEQ ID NO: 317 - DNA, 20 bp, Homo sapiens
gatgcttgctttgggaggta

SEQ ID NO: 318 - DNA, 20 bp, Homo sapiens
caggttagagcccatccaag

SEQ ID NO: 319 - DNA, 20 bp, Homo sapiens
aggctcagcttcatccacat

SEQ ID NO: 320 - DNA, 20 bp, Homo sapiens
aagcaaatatgcaaaattgc

SEQ ID NO: 321 - DNA, 23 bp, Homo sapiens
tccttctgtttcttgacttaaca

SEQ ID NO: 322 - DNA, 20 bp, Homo sapiens
gggaacaggtcacaggtcat

SEQ ID NO: 323 - DNA, 20 bp, Homo sapiens
ggaagactgggtggtcacag

SEQ ID NO: 324 - DNA, 20 bp, Homo sapiens
ttccttctgcttgtgagctg

SEQ ID NO: 325 - DNA, 20 bp, Homo sapiens
taccctcaccttcctcatgc

SEQ ID NO: 326 - DNA, 20 bp, Homo sapiens
gaagacattggcaggtctgg

SEQ ID NO: 327 - DNA, 20 bp, Homo sapiens
gagccctcatgttgggataa

SEQ ID NO: 328 - DNA, 22 bp, Homo sapiens
ttgttgattctcccattctgtg

SEQ ID NO: 329 - DNA, 25 bp, Homo sapiens
tcacctacctcatctcatactcaaa

SEQ ID NO: 330 - DNA, 20 bp, Homo sapiens
tcttccggacaagtttccaa

SEQ ID NO: 331 - DNA, 20 bp, Homo sapiens
tgggtcattctggacattca

SEQ ID NO: 332 - DNA, 20 bp, Homo sapiens
gcaaatgaggctggtaaggt

SEQ ID NO: 333 - DNA, 20 bp, Homo sapiens
tgcactgtggtagagggaaa

SEQ ID NO: 334 - DNA, 27 bp, Homo sapiens
caacatactcctatgcctagaaagaaa

SEQ ID NO: 335 - DNA, 20 bp, Homo sapiens
ctcaccaggcagaaacaggt

SEQ ID NO: 336 - DNA, 19 bp, Homo sapiens
cccaatggcatgcttcact

SEQ ID NO: 337 - DNA, 19 bp, Homo sapiens
ggttctcccagcattggtt

SEQ ID NO: 338 - DNA, 20 bp, Homo sapiens
aaggcctctgggtaggtagg

SEQ ID NO: 339 - DNA, 20 bp, Homo sapiens
aagcaatccttatgggctct

SEQ ID NO: 340 - DNA, 20 bp, Homo sapiens
ccaggtaatcagaagcctca

SEQ ID NO: 341 - DNA, 20 bp, Homo sapiens
ttccgttaaatccagccatc

SEQ ID NO: 342 - DNA, 20 bp, Homo sapiens
cagggactgcagtgtctcaa

SEQ ID NO: 343 - DNA, 20 bp, Homo sapiens
atgccacatttgcctctctc

SEQ ID NO: 344 - DNA, 25 bp, Homo sapiens
ccaccttccacttaatacaaacttc

SEQ ID NO: 345 - DNA, 21 bp, Homo sapiens
gaagcaatccattccaagaaa

SEQ ID NO: 346 - DNA, 20 bp, Homo sapiens
gtcctgagggtgtccaggta

SEQ ID NO: 347 - DNA, 22 bp, Homo sapiens
gctggagaactcctattctgct

SEQ ID NO: 348 - DNA, 20 bp, Homo sapiens
tggagctattgcggttctct

SEQ ID NO: 349 - DNA, 23 bp, Homo sapiens
tcaaatctctctttcctcctcct

SEQ ID NO: 350 - DNA, 20 bp, Homo sapiens
cagttccagctacgggagaa

SEQ ID NO: 351 - DNA, 20 bp, Homo sapiens
ccgcatttaggcaagtctca

SEQ ID NO: 352 - DNA, 20 bp, Homo sapiens
aagcacacacagatgctagg

SEQ ID NO: 353 - DNA, 20 bp, Homo sapiens
cctcagcctccataatctca

SEQ ID NO: 354 - DNA, 20 bp, Homo sapiens
gtacagagcccaccttctgg

SEQ ID NO: 355 - DNA, 20 bp, Homo sapiens
tcactatgctgcaaggcaag

SEQ ID NO: 356 - DNA, 23 bp, Homo sapiens
ggtgcttgctgtaaatataattg

SEQ ID NO: 357 - DNA, 20 bp, Homo sapiens
cactacagcagattgcacca

SEQ ID NO: 358 - DNA, 20 bp, Homo sapiens
gatttgaaaatgagcagtcc

SEQ ID NO: 359 - DNA, 20 bp, Homo sapiens
gtcgggcactacgtttatct

SEQ ID NO: 360 - DNA, 20 bp, Homo sapiens
tgggtgaagatgctacctga

SEQ ID NO: 361 - DNA, 20 bp, Homo sapiens
cccttcttcctttccctctc

SEQ ID NO: 362 - DNA, 21 bp, Homo sapiens
tgccaggtctgagttgtaagc

SEQ ID NO: 363 - DNA, 20 bp, Homo sapiens
cagcatgagaccctgtcaaa

SEQ ID NO: 364 - DNA, 27 bp, Homo sapiens
gaaagaaagaaagaaagaagaaagaaa

SEQ ID NO: 365 - DNA, 20 bp, Homo sapiens
aatcaccaaacctggaagca

SEQ ID NO: 366 - DNA, 27 bp, Homo sapiens
gaaagaaagaaagaaagaagaaagaaa

SEQ ID NO: 367 - DNA, 20 bp, Homo sapiens
aatcaccaaacctggaagca

SEQ ID NO: 368 - DNA, 25 bp, Homo sapiens
tctgagttaaacacttgagttgctg

SEQ ID NO: 369 - DNA, 21 bp, Homo sapiens
ccagtaaatggcagtgtggtt

SEQ ID NO: 370 - DNA, 27 bp, Homo sapiens
tgtcatggatatttctacataaaccaa

SEQ ID NO: 371 - DNA, 23 bp, Homo sapiens
tgaagatggttattgcttccttc

SEQ ID NO: 372 - DNA, 20 bp, Homo sapiens
cgctttgtttggtttggttt

SEQ ID NO: 373 - DNA, 20 bp, Homo sapiens
atgcagttgtcccacatgct

SEQ ID NO: 374 - DNA, 20 bp, Homo sapiens
tcctgcactccaaaggaaac

SEQ ID NO: 375 - DNA, 25 bp, Homo sapiens
aactctggtttaattcagctttgtc

SEQ ID NO: 376 - DNA, 21 bp, Homo sapiens
ttcttgagggcataaagctga

SEQ ID NO: 377 - DNA, 20 bp, Homo sapiens
cacactcaccaggcactctg

SEQ ID NO: 378 - DNA, 23 bp, Homo sapiens
caggtttgatgaaggaaatatgc

SEQ ID NO: 379 - DNA, 22 bp, Homo sapiens
gggatcctctgcatttctctaa

SEQ ID NO: 380 - DNA, 20 bp, Homo sapiens
tttgccaaatcaaccttcag

SEQ ID NO: 381 - DNA, 20 bp, Homo sapiens
cctgcttcacacctctgacc

SEQ ID NO: 382 - DNA, 20 bp, Homo sapiens
actcacacacaaccaccaca

SEQ ID NO: 383 - DNA, 20 bp, Homo sapiens
gctactggtgggtcgtaagc

SEQ ID NO: 384 - DNA, 18 bp, Homo sapiens
ttcagagaccatcacggc

SEQ ID NO: 385 - DNA, 25 bp, Homo sapiens
ctggaaaaatcagttgaatcctagc

SEQ ID NO: 386 - DNA, 20 bp, Homo sapiens
aggaaagccgagaaagcata

SEQ ID NO: 387 - DNA, 20 bp, Homo sapiens
catgtatccacatgcccaga

SEQ ID NO: 388 - DNA, 20 bp, Homo sapiens
ccttcagcgcagctacatct

SEQ ID NO: 389 - DNA, 20 bp, Homo sapiens
agaactgcgaggtccaagtg

SEQ ID NO: 390 - DNA, 22 bp, Homo sapiens
gggagaaagagaggtaggaagg

SEQ ID NO: 391 - DNA, 20 bp, Homo sapiens
ttcccaagttagcagcatcc

SEQ ID NO: 392 - DNA, 27 bp, Homo sapiens
ttctagaggagtctatttctttactgg

SEQ ID NO: 393 - DNA, 21 bp, Homo sapiens
ggagctgtcacttgagctttg

SEQ ID NO: 394 - DNA, 20 bp, Homo sapiens
ccgtgacctacagggaacat

SEQ ID NO: 395 - DNA, 20 bp, Homo sapiens
ggcatcgggtgtttctattc

SEQ ID NO: 396 - DNA, 20 bp, Homo sapiens
agacctgcctgtgttctggt

SEQ ID NO: 397 - DNA, 23 bp, Homo sapiens
ggagtgaaataagtggaactgga

SEQ ID NO: 398 - DNA, 26 bp, Homo sapiens
cattaaatgagtcataaaggtcatgg

SEQ ID NO: 399 - DNA, 20 bp, Homo sapiens
aacattgttgctttgctgga

SEQ ID NO: 400 - DNA, 20 bp, Homo sapiens
ggccttagctcagtttctgg

SEQ ID NO: 401 - DNA, 20 bp, Homo sapiens
tgcaaagacatttgcggata

SEQ ID NO: 402 - DNA, 19 bp, Homo sapiens
cctgcatttgtgtacgtgt

SEQ ID NO: 403 - DNA, 23 bp, Homo sapiens
cagagccgtggtagtatattttt

SEQ ID NO: 404 - DNA, 20 bp, Homo sapiens
ggaaccagtcatttgggtgt

SEQ ID NO: 405 - DNA, 20 bp, Homo sapiens
ttattgctccctcgtccaag

SEQ ID NO: 406 - DNA, 26 bp, Homo sapiens
tgccttaaggtctattatttcctttc

SEQ ID NO: 407 - DNA, 20 bp, Homo sapiens
accaatgcaggaagactcaa

SEQ ID NO: 408 - DNA, 21 bp, Homo sapiens
ctgatgaaaggacacacatgc

SEQ ID NO: 409 - DNA, 23 bp, Homo sapiens
tgcattaactatgcagcttgaaa

SEQ ID NO: 410 - DNA, 18 bp, Homo sapiens
gtcgtgcaatcccgagag

SEQ ID NO: 411 - DNA, 20 bp, Homo sapiens
ggattcctgctggctcttct

SEQ ID NO: 412 - DNA, 20 bp, Homo sapiens
ctggtgtggtcaggaaatga

SEQ ID NO: 413 - DNA, 24 bp, Homo sapiens
gtgctaaacacatgtgagtgagag

SEQ ID NO: 414 - DNA, 22 bp, Homo sapiens
tttgaccatgctttctctttga

SEQ ID NO: 415 - DNA, 20 bp, Homo sapiens
gcttgatgactccctgctgt

SEQ ID NO: 416 - DNA, 20 bp, Homo sapiens
aagccattgaaaggcaggta

SEQ ID NO: 417 - DNA, 20 bp, Homo sapiens
gggactttccggcttctatt

SEQ ID NO: 418 - DNA, 20 bp, Homo sapiens
ggtttgggaaccattctcct

SEQ ID NO: 419 - DNA, 22 bp, Homo sapiens
gcagagaagggatttactccag

SEQ ID NO: 420 - DNA, 20 bp, Homo sapiens
acttgacatggagcaagctg

SEQ ID NO: 421 - DNA, 21 bp, Homo sapiens
agctcatcatgctgtaaggag

SEQ ID NO: 422 - DNA, 20 bp, Homo sapiens
cacaggctctcacattctcg

SEQ ID NO: 423 - DNA, 20 bp, Homo sapiens
tgacactcatccctctgctg

SEQ ID NO: 424 - DNA, 27 bp, Homo sapiens
tgagtttcataagtttactacctgctg

SEQ ID NO: 425 - DNA, 20 bp, Homo sapiens
ggcagggagaaaggacaaat

SEQ ID NO: 426 - DNA, 22 bp, Homo sapiens
tcccttatgtgggattagttga

SEQ ID NO: 427 - DNA, 23 bp, Homo sapiens
cagacatggaactgagatttttt

SEQ ID NO: 428 - DNA, 22 bp, Homo sapiens
tgttccatctctctacccatgt

SEQ ID NO: 429 - DNA, 24 bp, Homo sapiens
tcaatgttcttattgagtgggaaa

SEQ ID NO: 430 - DNA, 20 bp, Homo sapiens
atatccacccacccacacat

SEQ ID NO: 431 - DNA, 20 bp, Homo sapiens
tagctctgagggcagagacc

SEQ ID NO: 432 - DNA, 19 bp, Homo sapiens
ccgtccttcctccactgat

SEQ ID NO: 433 - DNA, 20 bp, Homo sapiens
agagcactgagggagcaaat

SEQ ID NO: 434 - DNA, 20 bp, Homo sapiens
agctacagcacgaggcagtt

SEQ ID NO: 435 - DNA, 21 bp, Homo sapiens
tttgaattgagttgctgttcg

SEQ ID NO: 436 - DNA, 21 bp, Homo sapiens
tgtacaccaccaaccattctg

SEQ ID NO: 437 - DNA, 20 bp, Homo sapiens
gggaagaaaggcaaatagca

SEQ ID NO: 438 - DNA, 20 bp, Homo sapiens
ggattggcaattagcaggtc

SEQ ID NO: 439 - DNA, 22 bp, Homo sapiens
gcctggtcaaagataacagacg

SEQ ID NO: 440 - DNA, 20 bp, Homo sapiens
cctgattaagctggcctttg

SEQ ID NO: 441 - DNA, 20 bp, Homo sapiens
atccttctgggaccctcatc

SEQ ID NO: 442 - DNA, 20 bp, Homo sapiens
gctttgcttccttcttggtg

SEQ ID NO: 443 - DNA, 20 bp, Homo sapiens
caacattacggccagtctca

SEQ ID NO: 444 - DNA, 20 bp, Homo sapiens
ggtgcatctgataagccaaa

SEQ ID NO: 445 - DNA, 20 bp, Homo sapiens
gctgtcttggacacagtgga

SEQ ID NO: 446 - DNA, 20 bp, Homo sapiens
caccatcatcatctggttgg

SEQ ID NO: 447 - DNA, 20 bp, Homo sapiens
gagctcattgaaaggcagga

SEQ ID NO: 448 - DNA, 25 bp, Homo sapiens
ccatccatctatccatttatctctg

SEQ ID NO: 449 - DNA, 20 bp, Homo sapiens
ggatttatccttgccctgct

SEQ ID NO: 450 - DNA, 23 bp, Homo sapiens
ctatcatccatccatcctatttg

SEQ ID NO: 451 - DNA, 20 bp, Homo sapiens
ttagggcagctacctggaaa

SEQ ID NO: 452 - DNA, 20 bp, Homo sapiens
  misc_feature 8: n = A,T,C or G
aggactanagatgaatgctc

SEQ ID NO: 453 - DNA, 20 bp, Homo sapiens
gacatgactccatgtttggt

SEQ ID NO: 454 - DNA, 20 bp, Homo sapiens
cctcaccttgcaatttcctg

SEQ ID NO: 455 - DNA, 20 bp, Homo sapiens
ctgacttgcctgttggcata

SEQ ID NO: 456 - DNA, 21 bp, Homo sapiens
tttgggatcttgaagaccttt

SEQ ID NO: 457 - DNA, 19 bp, Homo sapiens
ttgtggcatgtccttggtt

SEQ ID NO: 458 - DNA, 23 bp, Homo sapiens
tgtacactgcaaacattgctaaa

SEQ ID NO: 459 - DNA, 24 bp, Homo sapiens
ttgtcctttcattatgacgtgtct

SEQ ID NO: 460 - DNA, 23 bp, Homo sapiens
aagcctgaaaggatacacacaaa

SEQ ID NO: 461 - DNA, 20 bp, Homo sapiens
caggatcccagactttccag

SEQ ID NO: 462 - DNA, 20 bp, Homo sapiens
ggtgaatcccaccctcatac

SEQ ID NO: 463 - DNA, 24 bp, Homo sapiens
ttggtatgtttcctattgttgcat

SEQ ID NO: 464 - DNA, 21 bp, Homo sapiens
gaaccagtgagtttttattac

SEQ ID NO: 465 - DNA, 21 bp, Homo sapiens
agacacagcatataatacatg

SEQ ID NO: 466 - DNA, 20 bp, Homo sapiens
tgaagctttgtggcttgttg

SEQ ID NO: 467 - DNA, 20 bp, Homo sapiens
gactgagtccacagcccatt

SEQ ID NO: 468 - DNA, 25 bp, Homo sapiens
cctggcctgttagtttttattgtta

SEQ ID NO: 469 - DNA, 22 bp, Homo sapiens
cccagtcttgggtatgttttta

SEQ ID NO: 470 - DNA, 20 bp, Homo sapiens
ccaccatgcaagaacagatg

SEQ ID NO: 471 - DNA, 20 bp, Homo sapiens
gctttgcacttggctgtctt

SEQ ID NO: 472 - DNA, 24 bp, Homo sapiens
ttgcatgaagtaaagtatccctgt

SEQ ID NO: 473 - DNA, 21 bp, Homo sapiens
cacaaaccacaagatgattgg

SEQ ID NO: 474 - DNA, 21 bp, Homo sapiens
gggcatcatgtctacaactca

SEQ ID NO: 475 - DNA, 20 bp, Homo sapiens
accaagggcacttgctgata

SEQ ID NO: 476 - DNA, 20 bp, Homo sapiens
aggatgaagagggaggaagg

SEQ ID NO: 477 - DNA, 26 bp, Homo sapiens
ccagactgatcttccttaattagttg

SEQ ID NO: 478 - DNA, 20 bp, Homo sapiens
cctcctctttctgctgctgt

SEQ ID NO: 479 - DNA, 21 bp, Homo sapiens
agccaaagaacccaaagaaac

SEQ ID NO: 480 - DNA, 20 bp, Homo sapiens
gccctactttgcctcagaaa

SEQ ID NO: 481 - DNA, 20 bp, Homo sapiens
gcaactcatgccagcctcta

SEQ ID NO: 482 - DNA, 22 bp, Homo sapiens
aactgtgttaatgatgggcaaa

SEQ ID NO: 483 - DNA, 20 bp, Homo sapiens
aacgagcgcatgaaacctat

SEQ ID NO: 484 - DNA, 20 bp, Homo sapiens
cctggtcaattgaacccaaa

SEQ ID NO: 485 - DNA, 23 bp, Homo sapiens
tgaaggaagataaagcagggtaa

SEQ ID NO: 486 - DNA, 20 bp, Homo sapiens
ctctctctggccctctcttg

SEQ ID NO: 487 - DNA, 23 bp, Homo sapiens
ggtaacttgccattcttctacca

SEQ ID NO: 488 - DNA, 20 bp, Homo sapiens
actccacctgaagggagaaa

SEQ ID NO: 489 - DNA, 21 bp, Homo sapiens
tggaagccactaattggagaa

SEQ ID NO: 490 - DNA, 23 bp, Homo sapiens
aatggatggatacctccttatca

SEQ ID NO: 491 - DNA, 20 bp, Homo sapiens
ctcattgtggctttctgtgc

SEQ ID NO: 492 - DNA, 20 bp, Homo sapiens
gtacccacacctcaccaagc

SEQ ID NO: 493 - DNA, 20 bp, Homo sapiens
cgtagctcacattcccaaca

SEQ ID NO: 494 - DNA, 20 bp, Homo sapiens
ggcgagtgaaagagaggaca

SEQ ID NO: 495 - DNA, 20 bp, Homo sapiens
gggtggtaattcccagatga

SEQ ID NO: 496 - DNA, 20 bp, Homo sapiens
tctgcaacagccagaatcaa

SEQ ID NO: 497 - DNA, 22 bp, Homo sapiens
tgtctgttggcaactttctgtc

SEQ ID NO: 498 - DNA, 20 bp, Homo sapiens
aggtgaacccagtccagcta

SEQ ID NO: 499 - DNA, 20 bp, Homo sapiens
tcttaggcaaaggagccagt

SEQ ID NO: 500 - DNA, 19 bp, Homo sapiens
acatgagcactggtgactg

SEQ ID NO: 501 - DNA, 20 bp, Homo sapiens
ggcctcaaatgttttaagca

SEQ ID NO: 502 - DNA, 20 bp, Homo sapiens
ttctgggtgttcgctattcc

SEQ ID NO: 503 - DNA, 20 bp, Homo sapiens
tttcctgtccagtcctgacc

SEQ ID NO: 504 - DNA, 22 bp, Homo sapiens
gttttgcaggtctaggtcacac

SEQ ID NO: 505 - DNA, 17 bp, Homo sapiens
aggatagcttgagcccg

SEQ ID NO: 506 - DNA, 396 bp, Homo sapiens
gattatatcccacctaccactgcagctccaggatccagcttcacaaacatttgttgaatgaatgaataagaaaagaggacacccccaaagaggctgcaagggaaaaagctacaaagacagaagcaccaggaaaaagtagggtcatgtaagtcaaagcaggaaaaaagttccatggtggggtggtcagcagtgtctaatrccacgaaggcacaaagtaggataaaggttaaaaatcagcctttggttttggcaaatatgaagcttatcggtagccttagcgagaacaattccatcagggagcagaagctaactgcagtgggttgagtcatcaagcaggcataaggaagtagggataccccattataagctactctttcaagaagctcaaatctgaag

SEQ ID NO: 507 - DNA, 396 bp, Homo sapiens
acaaaaattaccatcatatgctgtcatgcatgtctgccagtctatttatcatattatttaagaaacaaacatttattgaagatttatcatgtgctcagcactgccaaagaggaaataaagagcataatatctattcttagaaaataacattaacacaaatagaaaacaagaaaccataatgttaaaaatattacatagyaacacagaaagacaatgtataattatacatacgcactaaagcaaagataacataatttataaattatgaggtacagaatagttagattctgaaaattaaaataatcaggaaaaacttcatgaagatgagatctgggctggatcccaaaggataggcaggtggatcatgtagaacaggggaaaggagttcctgatcgg

SEQ ID NO: 508 - DNA, 396 bp, Homo sapiens
aactaaagaaagccacaaaagttcacctcaatgccaagacatttcttgatttttgaaaacccagttgtcgaaccacccatctatagaaacttgaaagactaaaaactatcttactctaaacattttctaggaagttgattctacaacacattttggttttccaatttggcttctaataattatttcaaagtttctgtgrcctaaattttgttttacattgatcctttgaatggactactgtttccacattttagaacatttaaaaagatatctacaacccgagtctaatcataaaaaaaatcagacagatccaaaatgtggaacattccactaaaaaaggagtggggagaggtctttattcttccaaaaatatcaatgccataaaagacaaagacg

SEQ ID NO: 509 - DNA, 396 bp, Homo sapiens
acccttcaaccccagcccagctgctaactgactacagccacatgaacagaaccaggtgagaccagaggaaacttccagtcacctaccagatcatgacaaataataaacgatgttttttaaaccacaaagatttggagcagcatttgttacacaaaattagacaactattacagttcgactaaaaacatgttcatttacratactaaattagaagtgtaagaatgggagaaaaacttcatactttaaaagtcattttttcctccaaaaacttccaactttgaaaaactgatttttataatgcataaaaattaaaataaccttagaatttatatgagtagcatagccagctggctttattatctgttgtactcaacacttcaataatcactgatgttt

SEQ ID NO: 510 - DNA, 396 bp, Homo sapiens
atgaccttacctcgttttgttttccttgtctgagagaaacacattagcagtctcccatcttgtttttccttttcctgtcacccaggacagagggcagtggtgtgatcacagctctgcagcacgacttccccaggttcaggtgatcctcccacctcagcctcccaaggagctgggaccacaggcacatgccaccacgtcsagcttaattttgtatttttttggtagagatcaggttttgccttattgccccaagctgatcttgaattcctgggctgaagcaatctgcctgccctggcctctccaagtgttaggattacaggtataagccaccgtgcagccttatattttgttttaaattttcctctgtatttttctctctggcaaattgtttaggga

SEQ ID NO: 511 - DNA, 396 bp, Homo sapiens
ttttttggtagagatcaggttttgccttattgccccaagctgatcttgaattcctgggctgaagcaatctgcctgccctggcctctccaagtgttaggattacaggtataagccaccgtgcagccttatattttgttttaaattttcctctgtatttttctctctggcaaattgtttagggagtttctttagtttatcrgactaaatttcaaggctttccttccaattttgacatgtaaacagtccctcatttctgcttatctagtgattattcccaaatctgtgtttacagtctagctgtctctcctgagattaagacttgtttctctaactacctgacggcagaatctcctcttggaagtatcaaggaggcagttcaaaactgaactgggcatt

SEQ ID NO: 512 - DNA, 396 bp, Homo sapiens
gctgatcttgaattcctgggctgaagcaatctgcctgccctggcctctccaagtgttaggattacaggtataagccaccgtgcagccttatattttgttttaaattttcctctgtatttttctctctggcaaattgtttagggagtttctttagtttatcagactaaatttcaaggctttccttccaattttgacatgyaaacagtccctcatttctgcttatctagtgattattcccaaatctgtgtttacagtctagctgtctctcctgagattaagacttgtttctctaactacctgacggcagaatctcctcttggaagtatcaaggaggcagttcaaaactgaactgggcattggctccactccttctccttctctttactattaataccc

SEQ ID NO: 513 - DNA, 396 bp, Homo sapiens
taagtcttatttaggcatcgtttcttctgggagacctttgtagaatctctgaggttatgttaacatgctaaggttttcttgacattctcagattgggttaggtgaacttttagcaacttatctttttactaaaaagtcatccctcagtatctgtggggaattggttctaggactccctaaggatatcaaaatctgcatragcagcccaggtgagaccagcagaagcactttacagtcacctacaggatcatgacaaataataaatcatgtttaagccacaaagtcctttacataaaatggtatagtatttgcatataacctacacatcttcctgtatcctttaaatcatctctagtttataatacctcatacgatgaaaatactacgtaaatagtt

SEQ ID NO: 514 - DNA, 396 bp, Homo sapiens
aagcagttcctaattactggacattctcagatctgctagagctacatgtccaattacgagaatatactggaaaaagccctggattagaaatgagaggatgtaggttttagtaccaggtcagccaccttgttaatgcaaatttgagtaaattgttacttcttttaggccttgtttttgctgttttgtttttctgacagtmtggtctctgtggtccaggctggagtgcagaggcacaatatcaggtccctgcagtctctacctcccaggatcaagccattttcatgcctcatcctcctgagtagctgggattacaggcatgtgccaccacaccctcgaactcctgacctcaagtgatctgcttgcctcagcctcccaaagtgctgggattagaggtgt

SEQ ID NO: 515 - DNA, 396 bp, Homo sapiens
gaatatactggaaaaagccctggattagaaatgagaggatgtaggttttagtaccaggtcagccaccttgttaatgcaaatttgagtaaattgttacttcttttaggccttgtttttgctgttttgtttttctgacagtatggtctctgtggtccaggctggagtgcagaggcacaatatcaggtccctgcagtctctrcctcccaggatcaagccattttcatgcctcatcctcctgagtagctgggattacaggcatgtgccaccacaccctcgaactcctgacctcaagtgatctgcttgcctcagcctcccaaagtgctgggattagaggtgtgagccactgtgcctagccttacacattgttttcttactggtaaagtgggaatatctaga

SEQ ID NO: 516 - DNA, 396 bp, Homo sapiens
gttttgtttttctgacagtatggtctctgtggtccaggctggagtgcagaggcacaatatcaggtccctgcagtctctacctcccaggatcaagccattttcatgcctcatcctcctgagtagctgggattacaggcatgtgccaccacaccctcgaactcctgacctcaagtgatctgcttgcctcagcctcccaaaktgctgggattagaggtgtgagccactgtgcctagccttacacattgttttcttactggtaaagtgggaatatctagaagttgcatgctacataaattcaaccatatattattggcaaaaaattttaaagaaaaacatcagcttaagagtactaattgagtacatgccttggaatgagcatgagctggaaagaacaaa

SEQ ID NO: 517 - DNA, 396 bp, Homo sapiens
ggcaaaaaattttaaagaaaaacatcagcttaagagtactaattgagtacatgccttggaatgagcatgagctggaaagaacaaacctgttgttacatcactcattgctgttttcatatgctgctcattgtaaatcttgctcagtggcatgattttagtgtttaaagatttatttgtttgtttgtttaggacaaagtcyctacacataatctacttgcttcatatatacatacttatgcatattatgtatgtacatacatgctctcagggctcacatgaaaaaacagccattcaggtgatgtgatttatctcatatgcttactttagagtcaacagggtgttgactccactatacaatactggcatggagaacacataagtcaaagtagacaggac

SEQ ID NO: 518 - DNA, 396 bp, Homo sapiens
tttatttgtttgtttgtttaggacaaagtctctacacataatctacttgcttcatatatacatacttatgcatattatgtatgtacatacatgctctcagggctcacatgaaaaaacagccattcaggtgatgtgatttatctcatatgcttactttagagtcaacagggtgttgactccactatacaatactggcatrgagaacacataagtcaaagtagacaggacccagccgtaccattggctagggcacaaatatattcacatatgtggagaatgatgtacgtagaaaggtcttcattgcacaatgctctttaataaagatctggaaaaaaaaaacacctaaatgttcaaaaggatagggtagatgaaataatggtacattataaaatggaa

SEQ ID NO: 519 - DNA, 396 bp, Homo sapiens
tctgtcacccaggctggagtgcagtggcatgatcatgtctccttgcagccttgacttccctggctcaggtgggcctcccacctcagtctcccaagtagctggaactacagtcgtgcaccaccatagccagctaagatagtgagatggtggccccactgtcttgcccaggctggactcgatttcctgggtgcaagcaccsttcccgcctcagcctcccaaagtgctgggattacaggcatgagtcaccattccagcctacttgtctttaattcttaaaaatattaatgttgagttttgtctcccagcatgtgggaaagatgtcatccattgcttctgtttcctggaggcctgggagcaaggagcccaggaacagtatcacgaagcttgagataatac

SEQ ID NO: 520 - DNA, 396 bp, Homo sapiens
atcattgatgggcatttgggttggttccaagtctttgctattgtgatttttttttttttttttttttttttaagacagagcctcactctgttgcccaggctggagtgcgatggcatgatctcagctcactgcaacctccgcctctcaggttcaagcaattcttctgcctcagcctcccaagtagctgggactacaggcrcccaccaccaggcccagctaatttttgtatttttagtagagacagggtttcaccatgttggtcaggctggtcttgaactccagacctcatgatctgcctgccttggcctcccaaagtgctgaaattacaggtgtgagccaccatacctggcctaggcagtctttttcaaaactctaagactgtgcttgtgtctcagg

SEQ ID NO: 521 - DNA, 395 bp, Homo sapiens
ggtatgaggtaaggatccatttttttcccatttgcatagccagtttttgtagctccactttattttctcacttgatctgccatgccacctctagcatgtatcaacatatcatgtatgtgtgcagctgttccttaactctcaattttattctcttggttactttgtctaacccagcactcatactttttaaattattayggctaccttgtagggcaagaatcctcacttttattcaacttcttttgaagtgtcttgatgcatattttttctgatcttacttggccatatatattttggggacagatgtgacatcataccaagctttctttgcttgacattgtagatattttcttattcattaatgtgctaaaaattttgagtttggtcatacagtc

SEQ ID NO: 522 - DNA, 396 bp, Homo sapiens
gtttctaacattatagacactagttttaggctcttggaggctagcagcaattctcagaggtaatgcaagcttccccatttcttcccgtagtcctgtgaaagaccagccacctccagaagcctacacatgagtcttctcagccatactttctgcttttcctaatgcctctcagcagcgtattagaaaggccatgatcgaygtacctgttaccttcaggctttgcataaggtgtatatgaaacataatgaatttcgtgtttaggctcaggtcccatccccaggttacctctttatcttggagacacttctggtcccatacatttcagataagagatattcaacctgtacccaccacgtaaggagaggaataggttttagaagaggagtcagggaggca

SEQ ID NO: 523 - DNA, 396 bp, Homo sapiens
gcatctattaaaagtgatggttttagtatcctgtctcattttttcctttccttacatcatgtattataggtaaacacatgcgcatgtgtgtatttctcttttagacaaaggatgagattactactgttagctcagtttttttttccctacttaacatctttgcttttattttttagacatatttctaagactattaaayattagacttacgtagcccttctgtcattgtgaaatacatagtttactaacagctaccatcaagataaagcctttatttaaataattaaacttcttagtggaaagctaagtaagcacagtttatggattttgggaatttttgccttgcatttgtctgatatggtaaaatattgagtttgtttttctcataatgttcac

SEQ ID NO: 524 - DNA, 396 bp, Homo sapiens
gataactcaatccccttaaagggttgtatcaagccattgataagggctcactttgatataaccattttctgttatttagacactctttcacacttcctattttcctcctggggatggtttgaatggatgacacaataccatattataaaagcactttacaaactgtaacttatgttataaatgtaattattaccttaargttttaccctgtttcagatttgagtggaagtagttctttacaatacaaaacaacttattttaactttttttgcatttcaaagaatgatcaatccacttcaggtgcagcatggtttccaaccctgacagcatggaagaatcatttatttagcttctaaaaatgtgcaggctgtaccctagaccagccttggggattag

SEQ ID NO: 525 - DNA, 396 bp, Homo sapiens
tcctctctctcattctctctctctctctctttctctctctccttctttgctccttcattccttctctctctctcttttttttttgagacagcatctcactatattgcccaggctgttctcaaactcctgggctcaagtgatcctcctgcctcagcttcctgagtagctaggactacaggcacatgctatggcaatactrttttaaacattgttttcaaggctccccaggtgattccagtgtgggtcatgtggtagagaaccactgacacaggcaaacaaaggatacataaagttgtctatttaatgggtaggtgcaggtagtagataagagtgtagccacataaaccacatgcttagtgaacggttttgttttgtgtgtatgtgagggattagcat

SEQ ID NO: 526 - DNA, 396 bp, Homo sapiens
ttcaggttccatttagcacgacagcagggaagggactgttggcagaaaaaaactggggcagtgggattaaagacagaccacacattccaaaaggcaccgtgggagggtcagggggcgaggttaggtctaggcttcagtgtcctgggagactcagtcttcacagggtgacagcgatcaagagtgcagcttaggctgggtrcagtggctcatgcctgtagtcccagcactttgggaggccgagacgggaggattgcttgaagccaggagtttgagaccagtctgaccaacatggcaaaaccccatctctactaaaaatacaaaaatcaactgggcatggtggcgtgtgcctgtagtcccagctacttgagaggctgaggcaagagaatcacttgaacc

SEQ ID NO: 527 - DNA, 396 bp, Homo sapiens
taaatgatcattatgttcatattcacacatacaataatgtactcaagtttattgctaaggtaattcagaatctccttattttgaagtgtgcatttgatatacctgtttgggaataactagtttcttatctttgacagaaaataattttgttgttttgtttttactaaaaaagcatggtgaaaaatggctccatttctawgagaggtaactaaaatatcgcaatttgctgggtgtcattaaagtaactcacaagggaaaaaatgcaaattggtatctgctgatggagtaaatctccgcagaagtgatgaccctgaaaggatcaatatattaaagcccctcccagctggtcattccagattgcaacaataaagcattaagtgttaaaacctcaaggca

SEQ ID NO: 528 - DNA, 396 bp, Homo sapiens
ctcatcaagcccacctttatacttcatttctccagacttcatgtccagactgtgggatgaacaagtggttataaggttttagaggctcctgtaggactagatggaaggcaaaaaaaggaaataacctttaagcatgctctcgattccttaaatcccatctgaaagtcttaaggatgtcttctcagtcatacttatttgrcaatattacctaattttctccattagcccaagctcaggggtctttcttcttccatattcacatgggtgcaatggttttctgaaaggaaaacagcattactagggcagtaacatttaattaatcacaggtacttatcaaactacaaaacaggcattccaggaactgggtgtttctgtttgtaaaattacactctcgtg

SEQ ID NO: 529 - DNA, 396 bp, Homo sapiens
taggactagatggaaggcaaaaaaaggaaataacctttaagcatgctctcgattccttaaatcccatctgaaagtcttaaggatgtcttctcagtcatacttatttgacaatattacctaattttctccattagcccaagctcaggggtctttcttcttccatattcacatgggtgcaatggttttctgaaaggaaaayagcattactagggcagtaacatttaattaatcacaggtacttatcaaactacaaaacaggcattccaggaactgggtgtttctgtttgtaaaattacactctcgtgtacatgctcccactaaaatgtaagttcgctgaggatggaggttttggtctctttgctctgtgctgtaaccccaacactgcagcagggcctg

SEQ ID NO: 530 - DNA, 396 bp, Homo sapiens
gctgcatagtctcacttaggtgtggaatctaaaaaagtcaaattaaaaaaaaatgtcaagcagagaatagaatggtagttgccagggactctgggaagtagcaggggtgggggtggaggggaggggatgggcagaagttggtcaaaaggtacaaagtttcaggtagacaggtgtaagttctggggatctattgtacagmgtggtgactgtagttaatactgtattgtgtacttaaaaattgctcaccaaaaatgttctcaccaaaaaaatgatgtttggatatgttaaacagtttgatttaatcattttgacgtgtgtgtgtgtgtgtgtgtgtgtgtgtgtgtgtatacatcaaaacatcacattatataccatatacaattaatatatacaatt

SEQ ID NO: 531 - DNA, 396 bp, Homo sapiens
ggggtaaatgctgactgcctgttctctggacaggaatggagaagatggtgctagcagggttgctgttcatatgtagacattcatgcagtcactctcttttcagcacacttcttacttctgccctgggttcagttgctgactctgagcccagaaaccttctagggttctgttaggtagattggcttccaccgtctttgcracaaccacagaaaattctagactgttttctcttcgggcttcattagtcaacttgcttcagtctgtcttgcatcttctaaatatttatagatctctctcttttgttggagtggcagaaaatgctagttgaccacccaatattcaaattatcctgcctccttaataacagaatatcattggatgtggtgggtaaataat

SEQ ID NO: 532 - DNA, 396 bp, Homo sapiens
atggagaagatggtgctagcagggttgctgttcatatgtagacattcatgcagtcactctcttttcagcacacttcttacttctgccctgggttcagttgctgactctgagcccagaaaccttctagggttctgttaggtagattggcttccaccgtctttgcgacaaccacagaaaattctagactgttttctcttcrggcttcattagtcaacttgcttcagtctgtcttgcatcttctaaatatttatagatctctctcttttgttggagtggcagaaaatgctagttgaccacccaatattcaaattatcctgcctccttaataacagaatatcattggatgtggtgggtaaataatataccctaactttccttgcagagaggggtggccaa

SEQ ID NO: 533 - DNA, 396 bp, Homo sapiens
cagggttgctgttcatatgtagacattcatgcagtcactctcttttcagcacacttcttacttctgccctgggttcagttgctgactctgagcccagaaaccttctagggttctgttaggtagattggcttccaccgtctttgcgacaaccacagaaaattctagactgttttctcttcgggcttcattagtcaacttkcttcagtctgtcttgcatcttctaaatatttatagatctctctcttttgttggagtggcagaaaatgctagttgaccacccaatattcaaattatcctgcctccttaataacagaatatcattggatgtggtgggtaaataatataccctaactttccttgcagagaggggtggccaatgagatggaaatgaaagtc

SEQ ID NO: 534 - DNA, 396 bp, Homo sapiens
tgggattgagttcttgatttgattttgagcttggccatcattggtgtatagcagtgctagtgatttgtgtacattgattttgtaacctaacactactaaattcacttatcaaatctgggagatttttgaggattccttaggattttctaggtatgagatcatatcattggtagaggtagtttgagtttctcttttccartttggatgccctttatttctttctcttgcctgattgctctgactagggcttctagtactatgttgaatagaaatggtgaaaagtgggcatccttgtctcattctaatttttagggggaaatgctttcaacttttccccattcattttgatgttggctgtgagtttgtcatagatgattcttactattttgagatata

SEQ ID NO: 535 - DNA, 396 bp, Homo sapiens
tcttttgccctgcctttctgcctttctgtccttttaatttgcgggcttttggcaaccacagcacgggtctggtttcctaggagtttcttttgtaggatcaaaccgctagttggctcttggccctgtgatagggccctgggctaacttattgggaaaatgttgctgtaacccctgcccagaggtgcctgtgacatgggcygccatcttctcctcttcccttggcttcagccccacctagaaacctgaacaaacattttccttgacatttcataaagtgtcagtggctcctcatttagcaaaatacatcccagggaagttcaaaagtgaaaaaaggccgtaacttcttcttcttctcagggacctacagaaaatatgtggcacctcggcagcctggcc

SEQ ID NO: 536 - DNA, 396 bp, Homo sapiens
catggattttgttttccaagtggcaagatggcgcctccacctttggtatcctattttagttcctggcagaaagaaaggaacaggctaatggccctgatgagtctacccccttttaacaggagaaaatttaaaaaacaaaaaccatgaaaccctttcccagaggcaacaaccagaattccatttatctttcattgaccaraacagaccacatggtcactggtggtggcaatggagactggggagatgaatatttttaaggtggcatattccagaagaacactgtgcactgattgcattaatgaacccattaatgtgccaaggggaggtttacctatgagcatgggcaaattagaacccactcttggagctgcaggtgagccaatcccacctaaacag

SEQ ID NO: 537 - DNA, 396 bp, Homo sapiens
tggtggtggcaatggagactggggagatgaatatttttaaggtggcatattccagaagaacactgtgcactgattgcattaatgaacccattaatgtgccaaggggaggtttacctatgagcatgggcaaattagaacccactcttggagctgcaggtgagccaatcccacctaaacagtgtggatgctacaagatggrgaagtaaattgattctattccataccctaacctctctccaagatgtattcttaaaatagaagagggaagacagaagaaaacatccagaatatatttttattgtcttttacttcttcagtgcattttagatcagtgcttctcaatctggcaaggggcatgcaggaggatgtgagttttatcaggaaaactacacaacc

SEQ ID NO: 538 - DNA, 396 bp, Homo sapiens
tgagccaatcccacctaaacagtgtggatgctacaagatggggaagtaaattgattctattccataccctaacctctctccaagatgtattcttaaaatagaagagggaagacagaagaaaacatccagaatatatttttattgtcttttacttcttcagtgcattttagatcagtgcttctcaatctggcaaggggcrtgcaggaggatgtgagttttatcaggaaaactacacaaccccccaaccacaatgctacccccactcctgtggaccttctttaagagagactcactattatagatggagttgatacgattttaagagaggccatatattatttgctttctgtcttgaaaaacttgtgatttttctgtattgtgctactgccaaagaga

SEQ ID NO: 539 - DNA, 396 bp, Homo sapiens
gggttgcagtgagcagagatcacaccattgcactccagcctgggtggcagagcgagattctgtctaaaaaacaacaccgtatttggggcatgctgatactaaaaaattattcattgtttgtctgaaattaaaatttaaattgggggccctgtattttactgggcaacccatttgcaatatcagcaacaatctcttattsagaccactgattaagtgtgcaaaatttgaatctctgaacagtacctatgtccttgatatcttaaattaatgagtgtcttagacactcaaagcaggaggaagcattatggcagatgtttgagccccagagatgtccatgagcacagcatagagctcagagccttctttattatttgcttcacgacagagcaaaggact

SEQ ID NO: 540 - DNA, 396 bp, Homo sapiens
catttgcaatatcagcaacaatctcttattcagaccactgattaagtgtgcaaaatttgaatctctgaacagtacctatgtccttgatatcttaaattaatgagtgtcttagacactcaaagcaggaggaagcattatggcagatgtttgagccccagagatgtccatgagcacagcatagagctcagagccttctttrttatttgcttcacgacagagcaaaggactgcagcaggttgactgatataaaagttttaccatgtctcacagcaggcctttgctcaagtttccagtaaggatattgtatcatttcttgcctgcagtacttgtaaatccacttacactgcctgctgttgagtcatttgtttcgtcttgagtagcatgtcatccttgttc

SEQ ID NO: 541 - DNA, 396 bp, Homo sapiens
ttgcagttctcattgctggggagtctaaactggaataaaacacccactatctccatcaggcttgcactagagcccagctctagctggagagaaagaagctaacccgcacagacacaggactgtaggcagggagcatccgggggtatttgggtcctggctctgatgtgcctaaggccaacttctctctggccatgctggygtgcatgagctcactaatcttcctttttgccttccattttctccaatcctgacttagcaaaggttgggcaaaagagactctgtgtgagttcgagcaaagcctgagatgctggattttccaagatacgagaaggggctgggggctgggtgaactggtggtggaggagggaaggattaatttcccaaggaggggaaggg

SEQ ID NO: 542 - DNA, 396 bp, Homo sapiens
gagaaagaagctaacccgcacagacacaggactgtaggcagggagcatccgggggtatttgggtcctggctctgatgtgcctaaggccaacttctctctggccatgctggcgtgcatgagctcactaatcttcctttttgccttccattttctccaatcctgacttagcaaaggttgggcaaaagagactctgtgtgarttcgagcaaagcctgagatgctggattttccaagatacgagaaggggctgggggctgggtgaactggtggtggaggagggaaggattaatttcccaaggaggggaaggggccaggacatcaggccccggggactttgaagagagggtcgtgggtaggaggtagatcaagtggagtgacacaaaggtcaggaaagagg

SEQ ID NO: 543 - DNA, 396 bp, Homo sapiens
catgcctcctacaaatttgacctgggcccagggccatgttcggtggtttttaagaaccgaggctcccagaagcagtattgggcagctagagtggccccaggatctatatcaaactctacctgtttctgaaccaaatttcttctagaattttattccataaatctgaattatggtgtcagactcctagcatacactaaakgaactctctgccttgcattaaataacaggagttacccctggaggtaactcctagccctggctctttagagaacagatgccgaataggcattaggggatgtgatggatgtgctaactttcaaaaaaaaaaaaaaaaaaaggcctgagctgagtgctcagagattcacaaaaagctgacagcatctctctgttccattg

SEQ ID NO: 544 - DNA, 396 bp, Homo sapiens
ctttggagcctggcagcctggctttgagaaccgggctttaacttgtcacatgactatggccaagttcctggggctctccaagcttcacttcctctgtaaaaagggcaataatataatacctgtcttattgggttttgtccatgttagatgagacattgggtacaaagcacttggtcccgtgcctggcacatttactgcrcttaatgtatgatagttttcttattattctaataaacaatatggctttgggagtatagttctgccacattgcagtggccagagtgaaggtggtgagtgccttctggggccctgggagtcaaggttatccgcatgccctttcttgcttgctcctcagtgtggctgcctctatgtccacaccatgcagatgcaacaggt

SEQ ID NO: 545 - DNA, 396 bp, Homo sapiens
acatgatcatccccttgggcttctggttttttttctttcaggaccttattttcaggcaagtggcctttgacctctaaggctgtcctttcctagctaccgaatccagcattcaaagtgatggaaatatgtatatatagtaatagtaaaatatcagcacttaatggcctgataagaatgtcactgcaatgctgagtttggrccaacatttgcctgctcctgccattgagcccgggctcccctccagagctgagctgctgcaagggatctgagtaactagggctgtgtcagagtggcgatgacagccaccacatgctaaggaagagatccccaaggacaaggagaatcccacgtggagctacttgcttctttgtcagtcttgtttttcttatttcacaa

SEQ ID NO: 546 - DNA, 396 bp, Homo sapiens
ccgaatccagcattcaaagtgatggaaatatgtatatatagtaatagtaaaatatcagcacttaatggcctgataagaatgtcactgcaatgctgagtttggaccaacatttgcctgctcctgccattgagcccgggctcccctccagagctgagctgctgcaagggatctgagtaactagggctgtgtcagagtggcratgacagccaccacatgctaaggaagagatccccaaggacaaggagaatcccacgtggagctacttgcttctttgtcagtcttgtttttcttatttcacaaccttctaaaacacaatctctcaacctctattgttagcttgcatttttcaatcatgagcacagctttacctggctccatgctttgattgactctacc

SEQ ID NO: 547 - DNA, 396 bp, Homo sapiens
tcttatttcacaaccttctaaaacacaatctctcaacctctattgttagcttgcatttttcaatcatgagcacagctttacctggctccatgctttgattgactctacctgccaacactgcaacaacagggaaagggacaccggcctcataccattagatggtgtgtagcctgggcatgaggataattaaaaactcccwaggggattttaacatgtaacacagtttggaaaccattgatgtaagatcttcttactcaacatgtgctccaaggagctgttgtatcagcttatcagaaatgtagatcaggccgcacttggacctgtagaatcagaatctgcattttatcagattccgacattatttgtatgaacattagcttttgagaagtgttgctt

SEQ ID NO: 548 - DNA, 396 bp, Homo sapiens
cttttgacaccaactacaagtcaaggggttccccaaaccaccctgagttgtgataattcgctgggagatctgacagaactcactgaaggttgttatactcatggttgtgatctcttatagggagggaatacagattaaaatcagccaaaggaagaagcacacagcacagagtccaggacagtgcctgacatggagcccytacggtcctctcccgtggagtcacggacagcgccactctcctggcattgatgtgtgacaacacacagggagtgttccccaccagggaagccttggtgtccagggtctttactgtggctctgtcacatgagcacagctgactgcccatgcggccgatctgttcccagactctccaccgctacacatcactcacagtcc

SEQ ID NO: 549 - DNA, 396 bp, Homo sapiens
gtggctcacagaactcagggaaacacagctaccagtttattgcgaaggacattttaaaggataaaagtaggcagataaagagatgcatagggcgaggtgtggaaaggtccctagtgcaggagcttctgtccatgtggagcgggggtgcaccaccctctcagtacatgaatgagttctccttcacctgcctatcagcctytacatgttcagctccccaacccagtcctcttgggtttttatggaagcttcaagacacccacattctttccccagagtatagggcaagaccttctctggggagggttttaagacccacagtcagaaaggtggggtggggtcaagattagagtcctgccttgacgggcaggtgaaaggggtagggggagtaggtgagaa

SEQ ID NO: 550 - DNA, 396 bp, Homo sapiens
cgggggtgcaccaccctctcagtacatgaatgagttctccttcacctgcctatcagcctctacatgttcagctccccaacccagtcctcttgggtttttatggaagcttcaagacacccacattctttccccagagtatagggcaagaccttctctggggagggttttaagacccacagtcagaaaggtggggtggggkcaagattagagtcctgccttgacgggcaggtgaaaggggtagggggagtaggtgagaaaaattctgtttattttttctttttttttttgagacggagtttcactcttgttgcccagggtggagtgcaatggcacaatctcagctcactgcaacctccgcctcccaggtttaagcgattctcctgcctcagcctcccg

SEQ ID NO: 551 - DNA, 396 bp, Homo sapiens
atgagttctccttcacctgcctatcagcctctacatgttcagctccccaacccagtcctcttgggtttttatggaagcttcaagacacccacattctttccccagagtatagggcaagaccttctctggggagggttttaagacccacagtcagaaaggtggggtggggtcaagattagagtcctgccttgacgggcargtgaaaggggtagggggagtaggtgagaaaaattctgtttattttttctttttttttttgagacggagtttcactcttgttgcccagggtggagtgcaatggcacaatctcagctcactgcaacctccgcctcccaggtttaagcgattctcctgcctcagcctcccgagtagctgggattacaggcgtgtgccacc

SEQ ID NO: 552 - DNA, 396 bp, Homo sapiens
tcttcattccacaaagctcagtgtcaaaacatggggtttacactggaagctgaggtcacatcagtagccgggatcagggtcgccctagctgcccaatgcagctcccaggcctcctgtaaaaccttgacctttgaggtcatgacagccctctcctgctatgctcatagctgaccactgaactcctggacactccctcccscaagttcacagagaatgtgggcacatgccttacagtcttcccttgatccaaactactgccttcatcttgagtgacagcagcatcttttggatgtcttggcctgtctagctttatttttttgtgttctgccatcaagttgctacttctgttgccatcgtgcctgtcagcgcagtgcaggctgtggtgaaatcccacga

SEQ ID NO: 553 - DNA, 396 bp, Homo sapiens
tatttttttgtgttctgccatcaagttgctacttctgttgccatcgtgcctgtcagcgcagtgcaggctgtggtgaaatcccacgaactcaggcatcacactgaccgggtctgagtcctgtctcagttgtcagctagttgtgcaatgaagggaaagggacctacactttccaagcctcaattcactcatctatggcatkgtgacaataatggaggttgatttaaagtcctttgtaagaattaagagttataatagacataaagtgctgtatctggtatacctagaaaacattccataaaagttagtaattgttggtcatgtaatgatgactctctaggctaggatttcagcttcattgcatgcacatggtgcactcacagggcgtgacctctctct

SEQ ID NO: 554 - DNA, 396 bp, Homo sapiens
ggtatacctagaaaacattccataaaagttagtaattgttggtcatgtaatgatgactctctaggctaggatttcagcttcattgcatgcacatggtgcactcacagggcgtgacctctctctgtctcagtaacctcatctgaggaccgggataatcataccgcttcaaagggatgtcataaagattaaataatatgtrtaaggctgcttgcatttagctgcattcaacaaatatttctgtatctttctcctcatttctccttactttcttgcttattatctgctctaggtatagatttcagagaactaagcttgttacaatccttcataaaataaccaggttggttagggcatttccaagagtcaatactgtttagtgactattctctgtttaat

SEQ ID NO: 555 - DNA, 396 bp, Homo sapiens
aaggctgcttgcatttagctgcattcaacaaatatttctgtatctttctcctcatttctccttactttcttgcttattatctgctctaggtatagatttcagagaactaagcttgttacaatccttcataaaataaccaggttggttagggcatttccaagagtcaatactgtttagtgactattctctgtttaatctmttttgattgtccagggtcatcttttgctatgtcataggttgttggcttcttctagagaagtgagacgatggacaagttccaagtgagtgaggcgactggtcaggatattccgctgaaaaactcatgtcagttctaattcgtgattgtaattcaatcacagcctgagaacagtaggactgtagttcaaatgctctgtt

SEQ ID NO: 556 - DNA, 396 bp, Homo sapiens
cctgggttcaagcaattctcctgcctcagcctcccaagtagctgggactacaggcacatgccaccacgcccagataattttcgtatttttagtagagacggggtttccccttgttggccagggtggtcttgatctcttgacctcatgatccgcccacctcggcctcccaaagtgctgggattacaggcgtgagccaccrcgcccggcctctagaggataatttttaaatgtgcttttgcatttggaaaatgtgattggcatttttttctaattttctaatatgatacgctgtcggatgctatggattacttaaaccctctggctacctagaaagatctttaagtggttctcaacaagcttcatacgcaatgtaaattgtattatctctcaggatgt

SEQ ID NO: 557 - DNA, 396 bp, Homo sapiens
tgtgattggcatttttttctaattttctaatatgatacgctgtcggatgctatggattacttaaaccctctggctacctagaaagatctttaagtggttctcaacaagcttcatacgcaatgtaaattgtattatctctcaggatgtgtgagaacatctgtttttcttctaatgcagtaaacatataagggtctcttgrgatatcttttaaatagacttaatacaacattcaggaatgataacaaaatataatcacagttgtaagggaatgtgagcatttcatattaataacattggaaccttatgtttaatacagtgttaaaagttgacaaacatgtaggagtcagaaaattcaattaaaattatcacagtaatatgaatttagccacatcctgt

SEQ ID NO: 558 - DNA, 396 bp, Homo sapiens
acttaaaccctctggctacctagaaagatctttaagtggttctcaacaagcttcatacgcaatgtaaattgtattatctctcaggatgtgtgagaacatctgtttttcttctaatgcagtaaacatataagggtctcttgggatatcttttaaatagacttaatacaacattcaggaatgataacaaaatataatcacrgttgtaagggaatgtgagcatttcatattaataacattggaaccttatgtttaatacagtgttaaaagttgacaaacatgtaggagtcagaaaattcaattaaaattatcacagtaatatgaatttagccacatcctgtgttagttatgaaatccatttaacaccacaaacagtaatatttttagccagtttattca

SEQ ID NO: 559 - DNA, 396 bp, Homo sapiens
catttaacaccacaaacagtaatatttttagccagtttattcaaaaggaaaacaggaactaaaccactttcatgcaatatatactctgttaatgtggtcaggctaattttgctgggggaaggaacttaacttttgaatatttgaatgcccagtcatttaatctgaatatcctatttccttgcatgttgcaaaatttttktcaataaaaggcagaaaaagaaatctcttctccatgctcatccctaagagaatgggttgtctgtaccctgagagcattttatggaggggacaaccacttttctaattttccttcccacttctctgtgggcacaaatgctctttggttgaaagagttgtaattcagtcccaagatgaggtgtggttactgcatcccta

SEQ ID NO: 560 - DNA, 396 bp, Homo sapiens
tcaatccatgctccacactgcagccagagtgctctacaatgcaaatccatttgtgagactcctcctcttaaaatcctcaagtggcttctctttgcccccaggatcattttgaaactccttaatggaagaggcatggccctttgggatgtggttccccaacccctcccacatcatcttttcaatcagatttcccactaartggaaattttttcaggtcctcaactttatggtgactttctcttgctcaggatctttgaacatactgtttcttctttccttttgtatttgccaagacaacacttcctctggtaagattttcctgacatcctctataaaaaaagattgagatagttgactacccaaaatgtttcccattcattccaagctctattcaag

SEQ ID NO: 561 - DNA, 396 bp, Homo sapiens
aacacttcctctggtaagattttcctgacatcctctataaaaaaagattgagatagttgactacccaaaatgtttcccattcattccaagctctattcaaggcagtaaagtgcccggctgacagattgcattcctcatcttttctgaagctagcaatggccatgcaacagcattctggccaataagatagaagtcgaarttgaagggtgggatttccaagaaagctcgttgaagacataattcctcatttcacttcttactctttctctttcctgcttcctaaaatgcggtgcagatggcagacacttcaaagctgtctcaggcaatcaggtgatgttaaggcagaaaccagctttatgatgggtagaacaggaagaaagaaggcacctatgttct

SEQ ID NO: 562 - DNA, 396 bp, Homo sapiens
cctacaaatctcatgttgacattttatccctaatattggaggcagggcctagtaggaggtgttttggtcatagtgataaatggcttggtgccgttctcacagtaacgagtgagtttttattctagtggttcctgcaagaactgattgttaaaagagcttggatccttccacccctctctcactcttgcttcctctctcwcaccttgtaatctctacaagctcttcacctccccttctccttttgccataagtggaagatttctgaggcctcaccagaagcagatgttggttccatgcttcttgtacagcctgcagaaccatgagccaaatcaacttcttttctttataattatccagtctcaggtattcctttatagcaacacaaatggactaaga

SEQ ID NO: 563 - DNA, 396 bp, Homo sapiens
gttgtttccagctttgaactattttgaatcctaaaagactgccagttttgaatgagaccccagaacaatgaatgtaggctctgtatacaagttcaggctgctgggcaacttaggccttaagacacaactctgccacttaggccttaagacacaactgacatgatggtgcttaaagtggctgtgatggaaaaggaggctrtttggagcctttggagtgcctttataggtgaaccccagcatagcacctaatgatttggagcaaagctgtgtcattccccaaagataactattcgccttttgagaaacatcttctagctactatcaataataaacacagaatgcatcaccatgggccaccgtgttgtcttttgacctgagtttccattgtgaacaaga

SEQ ID NO: 564 - DNA, 396 bp, Homo sapiens
aactctgccacttaggccttaagacacaactgacatgatggtgcttaaagtggctgtgatggaaaaggaggctgtttggagcctttggagtgcctttataggtgaaccccagcatagcacctaatgatttggagcaaagctgtgtcattccccaaagataactattcgccttttgagaaacatcttctagctactatcrataataaacacagaatgcatcaccatgggccaccgtgttgtcttttgacctgagtttccattgtgaacaagagtcatttgatccaaggcagaaagttgggtgcacacagcagtgttccatcatcaaatggaatatgagattgggcccaagtaggtcctgcagacacaaataagttgcaagagcaagtagtacaggcg

SEQ ID NO: 565 - DNA, 396 bp, Homo sapiens
gaaaaggaggctgtttggagcctttggagtgcctttataggtgaaccccagcatagcacctaatgatttggagcaaagctgtgtcattccccaaagataactattcgccttttgagaaacatcttctagctactatcaataataaacacagaatgcatcaccatgggccaccgtgttgtcttttgacctgagtttccaytgtgaacaagagtcatttgatccaaggcagaaagttgggtgcacacagcagtgttccatcatcaaatggaatatgagattgggcccaagtaggtcctgcagacacaaataagttgcaagagcaagtagtacaggcgcttggcctggccagtactgttgccaagttgactgcttcccctcagtctgcatctgtggctt

SEQ ID NO: 566 - DNA, 396 bp, Homo sapiens
ccccaaagataactattcgccttttgagaaacatcttctagctactatcaataataaacacagaatgcatcaccatgggccaccgtgttgtcttttgacctgagtttccattgtgaacaagagtcatttgatccaaggcagaaagttgggtgcacacagcagtgttccatcatcaaatggaatatgagattgggcccargtaggtcctgcagacacaaataagttgcaagagcaagtagtacaggcgcttggcctggccagtactgttgccaagttgactgcttcccctcagtctgcatctgtggcttcatggggagtttcctatgaccacttgatggaggaaaaaacaaattggagcatagtttatagtgctggtactacccaaagtggctagct

SEQ ID NO: 567 - DNA, 396 bp, Homo sapiens
gtccgtgagttacagatctacacaaaatcacagagagtggttaatcgtttagtctgatggtcagggacttccaagagacatgattagaaaactggtgacaaggagtcctggggaagaggcatatggatacctctgaacacacacaaaacatgagaatatgtatcccatatgaatgttaaccaaagagcagccacaacasaagaggattttaaaatcagctgaataagatgattcattctgacagcatcagctagtctctttccccagccactgttgcccagtgggcttacatatatcatggccatgggggcagggctatgtatggacacagcaacatgaatttccactcatcaaggccaatttggctccagccattgctgagtgctcagcctgcca

SEQ ID NO: 568 - DNA, 396 bp, Homo sapiens
acatgattagaaaactggtgacaaggagtcctggggaagaggcatatggatacctctgaacacacacaaaacatgagaatatgtatcccatatgaatgttaaccaaagagcagccacaacagaagaggattttaaaatcagctgaataagatgattcattctgacagcatcagctagtctctttccccagccactgttrcccagtgggcttacatatatcatggccatgggggcagggctatgtatggacacagcaacatgaatttccactcatcaaggccaatttggctccagccattgctgagtgctcagcctgccaagatagaaatctacgccaatatggcaccattccctgggctagaaaaccaactggtggaaggttgattacattggacc

SEQ ID NO: 569 - DNA, 396 bp, Homo sapiens
gggaatacaatggtggttccactaaactgacagctgagtttgccatctcctcgtgccagtgaatacacaagcaaggaagggggttcctttctcacctagggtgactgatcctaattaccaaggagaaattggactgccacttcacaatgagggtgaggagtatgtactctatgtgtctgtgattaatgtcaatagaaartgacaccaacctagtacacagaggactgatcatggtccaggcccttcaggaatgaagatttgagtcaccaggcaaggaacttggactcactgaggagggcatattccaaggagaatattttatctatgtccatctatgtccatctatattccatctgtgttccccttggaattcctattcatgaacatggggaattc

SEQ ID NO: 570 - DNA, 396 bp, Homo sapiens
tatagaatgagtagtggaaggtagttataaatgtaagtcaaaaaccacacaaccaatttgagaaatgaggaaggtaatagtgttgaatatgtcttctttatcttgatataaatgtatttgtgcatatattaaccagtttatttatttattattattttttgagatgagctctcgccatgttgcccaggctggtcttgamctcctgggctcaactgattctaccatttagtcctccgagtagctgggactacaggcatgcaccaccatacccagctgaccagttttttcctattcctctacttaatttctctactatacaacataatatgtgttaatggtagttaactttatatctcagtattaagtcacaagatatcaaaaagggaatgcgactta

SEQ ID NO: 571 - DNA, 396 bp, Homo sapiens
atgtcttctttatcttgatataaatgtatttgtgcatatattaaccagtttatttatttattattattttttgagatgagctctcgccatgttgcccaggctggtcttgaactcctgggctcaactgattctaccatttagtcctccgagtagctgggactacaggcatgcaccaccatacccagctgaccagtttttycctattcctctacttaatttctctactatacaacataatatgtgttaatggtagttaactttatatctcagtattaagtcacaagatatcaaaaagggaatgcgacttagttacaagcagaatgaatatcactcaaagatgaataaagagaagagggttagtgcattttctgttggatgagagaaagtttcattgtt

SEQ ID NO: 572 - DNA, 396 bp, Homo sapiens
gcagtggcgtgatcccagctcactgcaatctctgcctcctgggttcaagtgattctcctgcctcagcctcccgaggggctgggattgtaggcgtgcaccactatgcccatctaatttttgtatttttagtagagatagggttttgccattttggccagactgtcttgaactcctgacctcaggtgatctgcctgcctcrgcctcccacagttttgtgattataggcatgagccaccgtgcccggccttaacctttgttttcttacacaacacactacgtgatgttttccacatgcatgggtcatttgcttcatttacgtacaaatgcataagcaatatactgtgtggtgtgagtttgtgatgggaaaaggaagaagttttgcggatactacactgg

SEQ ID NO: 573 - DNA, 396 bp, Homo sapiens
gcccaggctgttctccaactcctggactcaagccatcctctagcctcggccttccaaagtgctgggactataggcgtgagccacggtgccaggcccttgaccacatttttaacccctctgaacctcagtttcactttctgggcaatgggaggggggtaatttgtccctcagagggttgcactgaggggcaaatgtgagsctctgggtacaatgcccagtacagactaggtccccacgacacagccgctcagcggctccggattctgggctgctctggactgcggccaggcggtcttctgcgggaatccgggcaggcagggcgggctgcgctcccctccccggctctcccggtgccccttgtctttttgttctgtctcagcagctctctattaagat

SEQ ID NO: 574 - DNA, 396 bp, Homo sapiens
tttttgttctgtctcagcagctctctattaagatgaatggcatttccaaaggcttcacctctgataagtgttcctctgcagctgcagccagaatcttaatgtgcgcgctgtaatttaatggccgtctcggctattaacacgctcttctcgggtgaagtggactccctccatccccgggcctctgcacgtgctctgcgcrctggctgggggtgactccaaggagctcagagcggggtgcccggcacctctcgccaggcgcctttcgaccttctaaagcgcgaatggctggacttttctcccatgtgtggggccccagaaggtgtggggccccagaaggtgtggggtccctgcgttccacggagcccggaaggtttccagtgatggtgggggctgacc

SEQ ID NO: 575 - DNA, 396 bp, Homo sapiens
ggagcccggaaggtttccagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcastccctcctcccaatttttatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctg

SEQ ID NO: 576 - DNA, 396 bp, Homo sapiens
cagtgatggtgggggctgaccacgttggtccccgtgggtgctgttttcatgtgccggcagattgggatgagtttaaaagacagaagcgtgtaggatagagaaacttctttaaaaactggaaattttaatctggggattataactattggacagtcaagtgcaagagtgaatacacttctcactccctcctcccaatttytatttgcgggattagtcagtccccctctgccacatgataattgtgagaactaccagggtcttcattctcctgccatctggttgacctctccaagaatggacacccgggcagcctgggccaatgaggctgtcctaagagtttagatgagagaagtcagtctttgacaggtgatggaagctgtaaaatgtaaaactcca

SEQ ID NO: 577 - DNA, 396 bp, Homo sapiens
taagagaagctgagagagagcgagaggagagattggaagaaagacagagacagaggtagagagaagggaaagagagagagaaagggacagaagagagagaaaaaagagggggccgggcgcggtggctcacgcctgtaatctcagcactttgggaggccgaggcgggcagatcacgaggtcaggagatcgagaccatccyggctaacacggtgaaacccccgtctctactaaaaaatataaaaaaaattagccaggcgtggtggtgggtgcctgtagtcccagctactgaggaggctgagacaggagaatggcgtgaacccgggaggcagagcttgcagtgagctgagatcgcgccactgcactccagcctgggcaacagagcaagactccgtctca

SEQ ID NO: 578 - DNA, 396 bp, Homo sapiens
tccaccagcagcttttctgagtctccagcttgcagatggcaaaccatgaaacttcatggtgtccatgagcatgtgaaccaatttctattataaatctgcaatatatatatatgaggagacttatttatatattggttcagtttctctggagagccttggctaatataaagtctatactctacaaagtgccctaggtackcagggagtacccaagtgtgtcatgaccagcccgacagccctggctgctggcttccccgcacacaactctgcacgctgccttcatcagcctttctctctcagctgaaccgagggcattgaagcgggcctctggcactgtacctatgagggagcaatatcttcccctacactgacctcttccgtgccgagatgcagccc

SEQ ID NO: 579 - DNA, 396 bp, Homo sapiens
gcctctggcactgtacctatgagggagcaatatcttcccctacactgacctcttccgtgccgagatgcagccctccctgctgccactagttacagtggtccatgttccctttcaaagtgaagttttgataaaagcacctcttaaccaatgccaaatagctaagtctgggacaaagattgcaggtattttgcattttccwtgtaacctcagagggattgccattcacactgatctgagctgcagaataccaggcagccacctcacccacccagcaggtccactcttatactttctcagaaagcacagccactctactcttattcagttgaaaagaatttccaggaaggtgtttctgcgattgcctcagaaaagtcagttccctttgggaatttccct

SEQ ID NO: 580 - DNA, 396 bp, Homo sapiens
tacttttctctgaagaaatggagatatcagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttayatttgtgtgtgcgtgtgtgtgtgtgtgtgagacagtcttgctctgttgcccaggctggagtgcagtggcataatcattggctcactgtagcctcaaagtcctgggcccaagcaatcttcccacctcagccacccaaaatgctggggttacaggtttatgccactctgtctgacctgaaagttttgggtttactttcc

SEQ ID NO: 581 - DNA, 396 bp, Homo sapiens
gcataatcattggctcactgtagcctcaaagtcctgggcccaagcaatcttcccacctcagccacccaaaatgctggggttacaggtttatgccactctgtctgacctgaaagttttgggtttactttcccttctttctctttgctgaagtcagagatgatggcagcttccagattctctggtgcctgtgctgggctcrtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaaaggaag

SEQ ID NO: 582 - DNA, 396 bp, Homo sapiens
cttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcamtcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtg

SEQ ID NO: 583 - DNA, 396 bp, Homo sapiens
ttttctaacatctgcagtgcaattgaagttaccagtcatctgcagtctaaaaagaaagtgattttgggaggtgcgtagaaaaaatcatcttattatttttcctctatattacttttttctttttttctcctgaagaaacttttttttttggtgataccttctttttctctagcacgtataattttggaagcatttttcrtatgcagtgtatacttcagaaagagagagagagagaggaaaattgtcctgttcagcgtttgcatttccattattcctgctattagttaaaaacaacaacaacaacaaaaaacaagcaggatacctagatctggaaaagggagaattgtgtagagctgtcttcctaaagttctgagttagggctgcctcagaccactt

SEQ ID NO: 584 - DNA, 396 bp, Homo sapiens
ttttggaagcatttttcatatgcagtgtatacttcagaaagagagagagagagaggaaaattgtcctgttcagcgtttgcatttccattattcctgctattagttaaaaacaacaacaacaacaaaaaacaagcaggatacctagatctggaaaagggagaattgtgtagagctgtcttcctaaagttctgagttaggrctgcctcagaccactttcataactatctccagtggctttgtgttttatatttattaagatagagaaaaaaagagtaattactaagggcagctgctgtagctttatggtgattactgaacattgacatgctgtcacgtttttggaactttgagtatttaatcactttgggatattctattttcccccatcttgagtgt

SEQ ID NO: 585 - DNA, 396 bp, Homo sapiens
ggaactttgagtatttaatcactttgggatattctattttcccccatcttgagtgtggacagatgctggtgatgtagccttctgggcacagagcaagcctccccctcagcctctgcaccagaaaggctcagcttcacacactccaagtatgttttctacaagaactacactttgtggctttctgacccaaacatttttrtactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcggata

SEQ ID NO: 586 - DNA, 396 bp, Homo sapiens
tgtggacagatgctggtgatgtagccttctgggcacagagcaagcctccccctcagcctctgcaccagaaaggctcagcttcacacactccaagtatgttttctacaagaactacactttgtggctttctgacccaaacatttttatactaaattacacacaacaaagttgtagctcagagagggaacaaatggcttayttaggccaccattttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcc

SEQ ID NO: 587 - DNA, 396 bp, Homo sapiens
tttttatactaaattacacacaacaaagttgtagctcagagagggaacaaatggcttatttaggccaccattttcttgagccattatgatttcacacagggctcccttggccctgtaaattggcaaggattccattattcaacccgcatacatgtacagagaccctgctctggcccagatagtattctgggtacaggcrgatagagcaggaaacaaaacagctacagtgatggacaggtcagcctgcagcaatgcctgcagtctctgcaaaggtagctgtatgggtgggcaggtggctagcacttattcagctctggaaggatctcccctctggcctctcccctgacacccatcaataaaactgaggagcatcggtggacaggggaccttgtgccc

SEQ ID NO: 588 - DNA, 396 bp, Homo sapiens
ttttcttgagccattatgatttcacacagggctcccttggccctgtaaattggcaaggattccattattcaacccgcatacatgtacagagaccctgctctggcccagatagtattctgggtacaggcggatagagcaggaaacaaaacagctacagtgatggacaggtcagcctgcagcaatgcctgcagtctctgcraaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagctacgaagtttgagctcactctctccagctccctctc

SEQ ID NO: 589 - DNA, 396 bp, Homo sapiens
gacaggtcagcctgcagcaatgcctgcagtctctgcaaaggtagctgtatgggtgggcaggtggctagcacttattcagctctggaaggatctcccctctggcctctcccctgacacccatcaataaaactgaggagcatcggtggacaggggaccttgtgccccctccctgcctgtgcagttggggctgaacccagcyacgaagtttgagctcactctctccagctccctctcaattcagagctgaactgtgggaagcttcagagctctctgtttcaaggacaggttctcctcacctctcctaatggaggtgcaccagggaactggccctgctctgcccagggctttctcctggactttgccatcatggtctagcaaaccctgttcagattgagg

SEQ ID NO: 590 - DNA, 396 bp, Homo sapiens
cactctctccagctccctctcaattcagagctgaactgtgggaagcttcagagctctctgtttcaaggacaggttctcctcacctctcctaatggaggtgcaccagggaactggccctgctctgcccagggctttctcctggactttgccatcatggtctagcaaaccctgttcagattgaggtgagtggtgagatttygaattctttttgacagataggattaagtcttcttctgtgggacaagtgggaggtagaggtaagattaaagatggccaaatgtctgagtcctgacagccacaatatggagatctagactttttacagaccacagggcacaggggcctcactaacagagttcccggaagtgatgagtgtgctgggggcttcctggttga

SEQ ID NO: 591 - DNA, 396 bp, Homo sapiens
taggattaagtcttcttctgtgggacaagtgggaggtagaggtaagattaaagatggccaaatgtctgagtcctgacagccacaatatggagatctagactttttacagaccacagggcacaggggcctcactaacagagttcccggaagtgatgagtgtgctgggggcttcctggttgaagagacactagaatggacsagctgggagctaattttttgggctggagtgtgatggcctgcacatcactgcctctgtccctccattgtcacagctgccccttaggagccagctgaggcaatttgtggtcagagtgactttgcacagttgtcctgcctgtgttcaggaagggagtttctgtggtccctttgaaaccacagaagagcccctcgtatagc

SEQ ID NO: 592 - DNA, 396 bp, Homo sapiens
agttgtcctgcctgtgttcaggaagggagtttctgtggtccctttgaaaccacagaagagcccctcgtatagctctcaatggagggggcaaaacattcaaataactcaggagataacacaactatttgtttttaactgtgagtttttaggcaatcacaaagatccagatgtatgtccaagcctctctttgcaattctawttaacctcaatgttgcaaccatagacctaccttacagagttcaaaaaaatatgcaaaaaccctgcctttcttcttcctcataccccaaaatgccattctgaacatttcctgttagttaaaaaaagatttccatggtgttaccaggcactgtacacagtctgtgtcccaagacaaggaggtacagttccacatgcgcc

SEQ ID NO: 593 - DNA, 396 bp, Homo sapiens
agggggcaaaacattcaaataactcaggagataacacaactatttgtttttaactgtgagtttttaggcaatcacaaagatccagatgtatgtccaagcctctctttgcaattctaattaacctcaatgttgcaaccatagacctaccttacagagttcaaaaaaatatgcaaaaaccctgcctttcttcttcctcatwccccaaaatgccattctgaacatttcctgttagttaaaaaaagatttccatggtgttaccaggcactgtacacagtctgtgtcccaagacaaggaggtacagttccacatgcgcccatgactgggttgggctctgcactctctctatactttgagagcctgattttctgtgattgggcagagctggcccacctggtg

SEQ ID NO: 594 - DNA, 396 bp, Homo sapiens
tctgcactctctctatactttgagagcctgattttctgtgattgggcagagctggcccacctggtgcaatgtcctcctctgcctttcaaacatgttttagtcatcaagatcttcaaatttgtaaccctttccagcttgatccagcagaatgcagatttggaaaaacagaacgagtttaaaatacatgattctaagaaayctggaccagaactatcaaaacttggtttcccagagaatatagcaaatgggctcattggccaatactatgacattggcttttgagaaaagaaaggctttattgcaaggctggccagcaaggagacaggagttgggctcaaatctgtctccccagtttggggcttagggcaagttttaattacacagacgcatttctta

SEQ ID NO: 595 - DNA, 396 bp, Homo sapiens
aaccctttccagcttgatccagcagaatgcagatttggaaaaacagaacgagtttaaaatacatgattctaagaaacctggaccagaactatcaaaacttggtttcccagagaatatagcaaatgggctcattggccaatactatgacattggcttttgagaaaagaaaggctttattgcaaggctggccagcaaggaracaggagttgggctcaaatctgtctccccagtttggggcttagggcaagttttaattacacagacgcatttcttatgagtagcaggcagagagcctccaacttcttctgcctaggtaccagcagcttagacatgatgcaaacctgggaagcacatactgtatttggagaaagtgattgggaagaaatgtgagctgag

SEQ ID NO: 596 - DNA, 396 bp, Homo sapiens
tacatgattctaagaaacctggaccagaactatcaaaacttggtttcccagagaatatagcaaatgggctcattggccaatactatgacattggcttttgagaaaagaaaggctttattgcaaggctggccagcaaggagacaggagttgggctcaaatctgtctccccagtttggggcttagggcaagttttaattayacagacgcatttcttatgagtagcaggcagagagcctccaacttcttctgcctaggtaccagcagcttagacatgatgcaaacctgggaagcacatactgtatttggagaaagtgattgggaagaaatgtgagctgaggggaggggctcagtgcccctgagctacacttagtgatggcagaggaaggatgtcctccc

SEQ ID NO: 597 - DNA, 396 bp, Homo sapiens
tggggcttagggcaagttttaattacacagacgcatttcttatgagtagcaggcagagagcctccaacttcttctgcctaggtaccagcagcttagacatgatgcaaacctgggaagcacatactgtatttggagaaagtgattgggaagaaatgtgagctgaggggaggggctcagtgcccctgagctacacttagtratggcagaggaaggatgtcctcccgcaggaggctgttccacatctgctctggttgtagggggagctggcaggcattagcagcggcctctttcccccaagagaggcagcctcctccaagttttggcgacattatggccctgcaatcataagggtttgtgagcatagtgctaaggagggaaatggagctgctgttacta

SEQ ID NO: 598 - DNA, 396 bp, Homo sapiens
cctcctgagtagctaggactacaagcatgtgccaccacgcccagctaatttttgtatttttagtaaggacagggtttcaccatgttggccaggttggcctccaactcctgacctcaagtcatcctcctgcctcgacctcccaaagtgctgggattacaggcatgaaaccagcctagaaatacatactattatttattcytgttttacagataagcaaagtgagtcatggagaatttggttgaaagtcccaaggtcaggagtcgtgaagctgggattaaaacctaatcatctgactttagagagtagacacttgctccatgcatattgcctccaattcattcattcaagcactccctgctcaagaagttctttcttatgttgagctgaaatctgcag

SEQ ID NO: 599 - DNA, 396 bp, Homo sapiens
tcatctgactttagagagtagacacttgctccatgcatattgcctccaattcattcattcaagcactccctgctcaagaagttctttcttatgttgagctgaaatctgcagccctatgcgttttacccagcagtcctggtgctgttccctaaaatcacttagactgtgcctgctctttctgtgtttacagtgtcagctrtaatatccccctcttcggcctaacgtttctgaagtcccttgccactgggtctcctctcctcttcctgtgttctttctaagaacacctatgcagataggtgtcttctgtacagggaagctgttcctgagatccgggcatcgactctgttagaataatctacgtatgagttatttttttgagaactatgtgtcattgct

SEQ ID NO: 600 - DNA, 396 bp, Homo sapiens
atgttgagctgaaatctgcagccctatgcgttttacccagcagtcctggtgctgttccctaaaatcacttagactgtgcctgctctttctgtgtttacagtgtcagctgtaatatccccctcttcggcctaacgtttctgaagtcccttgccactgggtctcctctcctcttcctgtgttctttctaagaacacctatrcagataggtgtcttctgtacagggaagctgttcctgagatccgggcatcgactctgttagaataatctacgtatgagttatttttttgagaactatgtgtcattgctgactcatattaactctgtggttaactaaaatctcaagatctctttatgtttgttgagaaacttatttaacttctctggccctccgtttcc

SEQ ID NO: 601 - DNA, 396 bp, Homo sapiens
gtcctggtgctgttccctaaaatcacttagactgtgcctgctctttctgtgtttacagtgtcagctgtaatatccccctcttcggcctaacgtttctgaagtcccttgccactgggtctcctctcctcttcctgtgttctttctaagaacacctatgcagataggtgtcttctgtacagggaagctgttcctgagatcygggcatcgactctgttagaataatctacgtatgagttatttttttgagaactatgtgtcattgctgactcatattaactctgtggttaactaaaatctcaagatctctttatgtttgttgagaaacttatttaacttctctggccctccgtttccttcactgagcagtggagtgattgataacctccacctgtggtt

SEQ ID NO: 602 - DNA, 396 bp, Homo sapiens
cacctatgcagataggtgtcttctgtacagggaagctgttcctgagatccgggcatcgactctgttagaataatctacgtatgagttatttttttgagaactatgtgtcattgctgactcatattaactctgtggttaactaaaatctcaagatctctttatgtttgttgagaaacttatttaacttctctggccctcmgtttccttcactgagcagtggagtgattgataacctccacctgtggttgctgaaggtcttgcacaagatgatatagttaaagtagctagcagtgcccacgtacggcggatgcctcacaacggtttgcagccatctctctatctgtgtctttgtctctctctcacactggttttggcttactgttagcagctagccga

SEQ ID NO: 603 - DNA, 396 bp, Homo sapiens
tctgtggttaactaaaatctcaagatctctttatgtttgttgagaaacttatttaacttctctggccctccgtttccttcactgagcagtggagtgattgataacctccacctgtggttgctgaaggtcttgcacaagatgatatagttaaagtagctagcagtgcccacgtacggcggatgcctcacaacggtttgcmgccatctctctatctgtgtctttgtctctctctcacactggttttggcttactgttagcagctagccgagataagtgtgtttatggtctttgcatgtattgtttctgtagcatactggaggattacaagaggttggggagtgagggggcggtgaggagtagacaaaggcagccaactcttccaagtttagcttagaa

SEQ ID NO: 604 - DNA, 396 bp, Homo sapiens
ttgataacctccacctgtggttgctgaaggtcttgcacaagatgatatagttaaagtagctagcagtgcccacgtacggcggatgcctcacaacggtttgcagccatctctctatctgtgtctttgtctctctctcacactggttttggcttactgttagcagctagccgagataagtgtgtttatggtctttgcatgyattgtttctgtagcatactggaggattacaagaggttggggagtgagggggcggtgaggagtagacaaaggcagccaactcttccaagtttagcttagaaggaaggagcggtaaaccctagttgaatgttggactgaagcaggtttgtttttgttttgtttaaaggatagggaagatctgtgcgtgtttccaggata

SEQ ID NO: 605 - DNA, 396 bp, Homo sapiens
acttgaagtcagtggcatggacagggtcaagatcacagttagaggatgcagccttagagaaaaggaaggggctcggttctctgagcaaggagggaaagaagagaggcagatgcagagaagtacggcacatcgtgctgctggttgtagaaataacctctgacttttaataaagtcatccctcggtatccctgggggattrgttctatgacctccctcggatgccaaaattcgtggatgctcaagtccctgatataaaatggcatagtatttgcatttaacctacacacatcctccatatcctttttttttttttttttttttttttttttttttttgtgagatggagtcttgctctgtcgccctggctggagtacagtggctcgatcttggctcact

SEQ ID NO: 606 - DNA, 396 bp, Homo sapiens
aatacctgatagaatgtaaatgctatgtaaacagttgttatactgtattgttaaaagacagtaacaagaaaaaaaatctgtacatgttcagtccagacaaatggttttctgttttttttttttttttttaatatttttggtcagtggttggttgactccaggaatgcagaacccgcagatatagaaggttgattatgcrttcagaggcagggaataccatcttgggttccagaaagaaaatgatcagcattttctgtcatactctggtaaaaacagatcttttgaatggacaggtgtattaaaccctgtggagctggctgggcctggcggctcacgcctgtaatcccagcactttgggaggctgaggcaggtggatcacgaggtcaggagttcgag

SEQ ID NO: 607 - DNA, 396 bp, Homo sapiens
tgccccgcagagtttgaagtcccggctgcacctctccccagcagcaggttgactctggaaagttgcagcgttcttacctacagagtgggaacagtactacccattgcacagagtgggtgcaaagctctgtgacggaatacatggcaagtgcccaccacattgcctgggatgaggtgggcccttcctttacgtaagagarccctacagatacactcaaagtgggcacattcctacagaaggagtgttatttgtgtagaaaagaaaaacatgaaaggcttttattcctatacacaataaagcacccctttaatgtctttttgaggaggataatatgaaattgatgaaaaggaaccctgtggttggatccctgacaatcacatgtatcccttttttcac

SEQ ID NO: 608 - DNA, 396 bp, Homo sapiens
  misc_feature (227)..(326): n = A,T,C or G
tacagatacactcaaagtgggcacattcctacagaaggagtgttatttgtgtagaaaagaaaaacatgaaaggcttttattcctatacacaataaagcacccctttaatgtctttttgaggaggataatatgaaattgatgaaaaggaaccctgtggttggatccctgacaatcacatgtatcccttttttcactcttraaaaaggagtaaaggaataaaatagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttcagtcactgtataataactagccagattttttgttgttgttgttttgtttttgtttttgttttt

SEQ ID NO: 609 - DNA, 396 bp, Homo sapiens
acattctgaaccacagacagttctttaccctgaacctttgcatattttgttctcttagcttagagcggcccctctccctccgtctgcttggctaatttctacttgttcttcagattttatcttagatgtcattccctcaaggaatccttctgtgactcaacatggaattaagttgcctcctttgaccctgaaagcaccrtgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagttgatggag

SEQ ID NO: 610 - DNA, 396 bp, Homo sapiens
aatccttctgtgactcaacatggaattaagttgcctcctttgaccctgaaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacartgttcagtagagagcagctgctgagtacgtttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtgg

SEQ ID NO: 611 - DNA, 396 bp, Homo sapiens
aaagcaccatgtactcaatctcatcttggcatgactcactttgctgtgtggaatgtctgctttccttgtttgtctattcctttagactgtaagatcctagaaagtgggggccgtgccttgctcatgactgtgtttctaacaccaaacacagtgttcagtagagagcagctgctgagtacgtttctgctaaatgacagtkgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaa

SEQ ID NO: 612 - DNA, 396 bp, Homo sapiens
ttctgctaaatgacagttgatggaggacatttagggttgcttggaggtcaagtcaaggaggcatttaacattctagtaaaacaaggaagtaacaggctcctgaacatgcccacaatgaaccagatgcaaaccttttcccttggcaggattctttgcccataaagtggagcacgaaagcaggacccagaatgggaggagyttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagtttctgagcgccagggaggtgaggaaggttggacttcaccagagag

SEQ ID NO: 613 - DNA, 396 bp, Homo sapiens
ggcatttaacattctagtaaaacaaggaagtaacaggctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaamcctgatgttgctaataagtgggggcatgggcaggggggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggg

SEQ ID NO: 614 - DNA, 396 bp, Homo sapiens
gctcctgaacatgcccacaatgaaccagatgcaaaccttttcccttggcaggattctttgcccataaagtggagcacgaaagcaggacccagaatgggaggagcttccagaggaccggaacacttgcctttgagcgggtctacactgccaagtgagtcctaaccctgatgttgctaataagtgggggcatgggcagggrggcctccttctaggagtgatgaccacccttaataccacatgtctgtctgagccaagtttctgagcgccagggaggtgaggaaggttggacttcaccagagaggctttgtggacaccctttatcatcttagtgagtgctagtgtcaaaacaaagggagtggggatatggggcacattggtggagggaggtgtgatctc

SEQ ID NO: 615 - DNA, 396 bp, Homo sapiens
ttgcccataaagtggagcacgaaagcaggacccagaatgggaggagcttccagaggaccggaacacttgcctttgagcgggtctacactgccaagtgagtcctaaccctgatgttgctaataagtgggggcatgggcaggggggcctccttctaggagtgatgaccacccttaataccacatgtctgtctgagccaagyttctgagcgccagggaggtgaggaaggttggacttcaccagagaggctttgtggacaccctttatcatcttagtgagtgctagtgtcaaaacaaagggagtggggatatggggcacattggtggagggaggtgtgatctctgcagcttcagaaagatctgaaagagtcatttggttagagaagttgacctatttcct

SEQ ID NO: 616 - DNA, 396 bp, Homo sapiens
aaacaaagggagtggggatatggggcacattggtggagggaggtgtgatctctgcagcttcagaaagatctgaaagagtcatttggttagagaagttgacctatttcctgtggggttagaccagggttgctactgtgaacaccagccatgactcaccagtcaccttcagaagccacaggcaggacatgctgacgacagycttcaactcacccaccccttgctcccctgcgggtggaagtctggaggtgacaccactgcattttctaacacgggggctccttgagcaactagaacaagaacagaaagaatggggacattagcaggtgctttccccctctctcattcttttctttgaataaaaaggttgtttgaaaacacctgagcggctcctaaaga

SEQ ID NO: 617 - DNA, 396 bp, Homo sapiens
ctcctctcttctttatgcagagtgtatttcaaggctcagccagtggcaggcatgctggggactatggactacggactaggggcctgtcacagaggaaggcctcatgctagagagctaagggaggagctggccttcagttccatcccaggagcaactttgatgttcccagagatccttccaaagggggagtcatggtcamccaagaaaaatgtattcagaatgccaagaatggtgcaaactcaggacaaagattcacactgcagggttggagtccctgggcttgctgctggcaccatgggagggagggtccccttcaggggtaccgttggtttcctgtgaattaaactggcttcaagggatctcgactgaacaggcctatatcacactcactgatat

SEQ ID NO: 618 - DNA, 396 bp, Homo sapiens
tctcctcatctaggtatttttaattgtttcagtgaggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctytcagacagcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggtct

SEQ ID NO: 619 - DNA, 396 bp, Homo sapiens
atctaggtatttttaattgtttcagtgaggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctttcagacwgcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggtcttccatgt

SEQ ID NO: 620 - DNA, 396 bp, Homo sapiens
aggtgtaggcatgaggggattggagggggcatctcctccattgcagtttttcattggctgctttgctccctcagctccgaaatcgctgggccactctcgaacgcattagtacggtagtcacaggttgattgcctggccccttgccctctgtgggcattttccctttcagacagcccctgagtactcacagtgctgctayagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggtcttccatgtattaattctcagaatcaatttaagatg

SEQ ID NO: 621 - DNA, 396 bp, Homo sapiens
cctttcagacagcccctgagtactcacagtgctgctacagtgggccacctagatctccctctttctccatgctcccacgtgctctgggctccactcccttctcccaagcacttctgtccagggctattccagcagtctgacctcaaggaaatcctttgctaaactgattatagagaggtttctattttaacatttaggycttccatgtattaattctcagaatcaatttaagatgtttaaaggtgtgatttaagacattttaaaaccatttggaggagagtacagaaattatgtcacttgctgtcagcctctttgcaccatctgcagagaaagatactagagtcccgccttggacacatccacatgcaagaggtgcaaagaaggtgtctttgatga

SEQ ID NO: 622 - DNA, 396 bp, Homo sapiens
ttctcagaatcaatttaagatgtttaaaggtgtgatttaagacattttaaaaccatttggaggagagtacagaaattatgtcacttgctgtcagcctctttgcaccatctgcagagaaagatactagagtcccgccttggacacatccacatgcaagaggtgcaaagaaggtgtctttgatgaggcaaggtcaaaactyctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggttagaagttaagtttccaatttgctggcaatgaa

SEQ ID NO: 623 - DNA, 396 bp, Homo sapiens
aagaaggtgtctttgatgaggcaaggtcaaaacttctccccagacgaaatccaaagaaagcattcctactatgctatatcagtttggaaagaaaaacttctgccaggtgactgcattctcactggtcacattgtgttcctatggactcctcagctcaaccaatttggagaagttatggtgcaatttcaccatatctggytagaagttaagtttccaatttgctggcaatgaagaagaaatggagcaggccaggctgtgtagtttctgccacgtgcccccgggagtgaacagctctgtttgtaagaagccatggtgcttagacctgggctcgctagttgccagcctccaaattgcagaagtgccctttggttggtggctatgctgtgtcacttggga

SEQ ID NO: 624 - DNA, 396 bp, Homo sapiens
gcaacatatctgtgtgcctgtctgggttgtaaaaagggtcaaagatcaatgcagcaggcagctacatgctggcaaaagccagaggcagctggtctgtttgcctgtgccaggaaaccactgggaatggggttgtgtgttattctaggagaaagtcgtcccagcagcagcttctccaggggcatccaagagcactgaaaarggttgcaagatgacccatgaggctgcaggaagaaaagaacatgcatttaatcttgctatctgaaaagtaagacatgaagctttcctcatttttaatatacacatggacagtagtatgtgtatatagtttatatgcaaatatacttgttataaggttgcatgctcaaaatttttggttcatggggtgtgggatcataa

SEQ ID NO: 625 - DNA, 396 bp, Homo sapiens
cagctacatgctggcaaaagccagaggcagctggtctgtttgcctgtgccaggaaaccactgggaatggggttgtgtgttattctaggagaaagtcgtcccagcagcagcttctccaggggcatccaagagcactgaaaagggttgcaagatgacccatgaggctgcaggaagaaaagaacatgcatttaatcttgctrtctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggtg

SEQ ID NO: 626 - DNA, 396 bp, Homo sapiens
ctatctgaaaagtaagacatgaagctttcctcatttttaatatacacatggacagtagtatgtgtatatagtttatatgcaaatatacttgttataaggttgcatgctcaaaatttttggttcatggggtgtgggatcataaatgtttagggaccatggctatcaaggaaaaacagcatgaaggataaatgatactggyggattaaaaagacagatgcatgtatttttagcataaaacacaactgctgactgatacagatagctcaagattctggggcagctgctgaacagatacactagccagtgtggctcatcggctcagacttggccttaattaatgggctgtccctccacccatctcccatgagggcagagctgagccagggtttgagagct

SEQ ID NO: 627 - DNA, 396 bp, Homo sapiens
agtttatatgcaaatatacttgttataaggttgcatgctcaaaatttttggttcatggggtgtgggatcataaatgtttagggaccatggctatcaaggaaaaacagcatgaaggataaatgatactggtggattaaaaagacagatgcatgtatttttagcataaaacacaactgctgactgatacagatagctcaasattctggggcagctgctgaacagatacactagccagtgtggctcatcggctcagacttggccttaattaatgggctgtccctccacccatctcccatgagggcagagctgagccagggtttgagagctaaaaggaattggacctggactctgttcacgtgtatattttaattctaattaattcattcttttgaaaga

SEQ ID NO: 628 - DNA, 394 bp, Homo sapiens
gtatttttagcataaaacacaactgctgactgatacagatagctcaagattctggggcagctgctgaacagatacactagccagtgtggctcatcggctcagacttggccttaattaatgggctgtccctccacccatctcccatgagggcagagctgagccagggtttgagagctaaaaggaattggacctggactcdgttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcctgagtagctgggattataggcacatgcccccatgcctgactaatttt

SEQ ID NO: 629 - DNA, 396 bp, Homo sapiens
gctaaaaggaattggacctggactctgttcacgtgtatattttaattctaattaattcattcttttgaaagacagagtcacactctgttgcctaggctggagtgcagtggcacgatcttggctcactgcaacctcggcctcccaggttcaagttattctcctgcttcagcctcctgagtagctgggattataggcacaygcccccatgcctgactaatttttgtatttttagtagagacggggtttcaccatgtcaggctggtcttgaactcctgacctcaggttatccacccgccttggcccctcaaagtgttggaattacaggtgtgagccaccgtgcctggcctgttcacatgtataaaacacagtttaatgtcctattcccagccaatgagc

SEQ ID NO: 630 - DNA, 396 bp, Homo sapiens
tcaggttatccacccgccttggcccctcaaagtgttggaattacaggtgtgagccaccgtgcctggcctgttcacatgtataaaacacagtttaatgtcctattcccagccaatgagcatggctagagcagccttggtcaaagtttggtttttggagaaaaatccttgttagctgacctaagattcctctttgtgagtktaagtaagcacaggttgcagagaggagaagggtctctggagaggtgtaattttctaaatggattacaagttcatggacttttaacaggtgttacaggggataacaagttctttatagacagacttttgaggacgtttaagggtattctgattcttggttttctaagaggggaatgtattatttaactacagacaccc

SEQ ID NO: 631 - DNA, 396 bp, Homo sapiens
aaaatccagaataataataatttgtcaataggaaagacatttccactgggggttaagaaggaagacattggaacaatgatagccaccacttattgaatgcttactgtgagccaggtggcacttcaccttgtttcattctcacaacagtctagggaagtaattactaatgtctccatccacctcttgtagatgagcaaaytgaggctcattgaggctaggaaatgcacccacactcacatagcccataagaggcagccatggcattgggcccagaccatgtgaacttcaaagactacacgagcagccactgggcagctgtcatggctaaagccacttgaattcagcccagcagcaaccccctctccaggaggggcacataagcttgcagctttgggt

SEQ ID NO: 632 - DNA, 396 bp, Homo sapiens
ataataataatttgtcaataggaaagacatttccactgggggttaagaaggaagacattggaacaatgatagccaccacttattgaatgcttactgtgagccaggtggcacttcaccttgtttcattctcacaacagtctagggaagtaattactaatgtctccatccacctcttgtagatgagcaaactgaggctcaytgaggctaggaaatgcacccacactcacatagcccataagaggcagccatggcattgggcccagaccatgtgaacttcaaagactacacgagcagccactgggcagctgtcatggctaaagccacttgaattcagcccagcagcaaccccctctccaggaggggcacataagcttgcagctttgggtagaagctgca

SEQ ID NO: 633 - DNA, 396 bp, Homo sapiens
gcacttgaagtcctggatggcgagagggactggcttgagccagagccaggaacaaggctctgagaatattctggaaatccacaggaggaacccattttcttacagctgggagaatttcattcaactccaggctgaccatgttttattaggaacgaaggtgacttgaactaatagtcaggaatggttgaatacggacccratgtcaaatcactaggcagttcacatttctaatgagcaaatcccttagacaattaagaatttttttccttttgcataacccagacaaaatcgctacttaaaaacaaaccaaagacccgaaacatgagaaagagaaggaagcaggggaaatctttggtactaataagtttttaaacaataagagcaccagatatttta

SEQ ID NO: 634 - DNA, 396 bp, Homo sapiens
atgagcaaatcccttagacaattaagaatttttttccttttgcataacccagacaaaatcgctacttaaaaacaaaccaaagacccgaaacatgagaaagagaaggaagcaggggaaatctttggtactaataagtttttaaacaataagagcaccagatattttaccccatcagacacagaatgttattcgaataacsaaaaaaggaattttttctctaagtttcttgaactggaaaatgaatcatattttctcagtcctgaggctgcaattttgtgcctctagtaacatataagaatagatgtgatgccagtgcccagtagctgctgcaattgttacttggggacctgtttattcactaagcacttcaccccagtgataaatttgtaggggcct

SEQ ID NO: 635 - DNA, 396 bp, Homo sapiens
ccgtgtccattagatcagtggaaattctgggattcagagcactttgcaaggtcagcaggggtctgctctttctgtcctgttcctggtttttggttgtgcctggattccagggtaggtttctcatctgttaccttcatagacttctccagaaaaggatcttttgaccatcagaggaccacgaagattccattggtgaggygcagataacctgatctctctgggttctctgcagggcacagatgaagggctggccattcccaagttctcagtggtaccactgaggcatgagaccctaatggtttgcatgagcagtttgaaaattgcatctttgtttttacctatataatcacatgaaacccgtggttctcaaacgtcagcaggcatcagcatcacatg

SEQ ID NO: 636 - DNA, 396 bp, Homo sapiens
tcagtggtaccactgaggcatgagaccctaatggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggygtgaacatttgcatttctaacatgttctcgatgctgctgccgcctctggtcccgagagcatgcctggagaactgccaccttcgaccatggactgtgagaattcacatggacctcagaattataatcagtctctcagttttacagataaggaaactaaatccagagagattgttttgccaatggtgaacagctggtta

SEQ ID NO: 637 - DNA, 396 bp, Homo sapiens
atggtttgcatgagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggtgtgaacatttgcatttctaacatgttctcratgctgctgccgcctctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtca

SEQ ID NO: 638 - DNA, 396 bp, Homo sapiens
gagcagtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggtgtgaacatttgcatttctaacatgttctcgatgctgctgcygcctctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttc

SEQ ID NO: 639 - DNA, 396 bp, Homo sapiens
agtttgaaaattgcatctttgtttttacctatataatcacatgaaacccgtggttctcaaacgtcagcaggcatcagcatcacatggagggcttgttaaaacagatttctgggccccaacacagagttttaaattctgaaggcctgaggtgggtgtgaacatttgcatttctaacatgttctcgatgctgctgccgcckctggtcccgagagcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctct

SEQ ID NO: 640 - DNA, 396 bp, Homo sapiens
catctttgtttttacctatataatcacatgaaacccgtggttctcaaacgtcagcaggcatcagcatcacatggagggcttgttaaaacagatttctgggccccaacacagagttttaaattctgaaggcctgaggtgggtgtgaacatttgcatttctaacatgttctcgatgctgctgccgcctctggtcccgagakcatgcctggagaactgccaccttcgaccatggactgtgagaattcacatggacctcagaattataatcagtctctcagttttacagataaggaaactaaatccagagagattgttttgccaatggtgaacagctggttaaagtcaggatggagactttaatcctagtcaagtgacctttcctctgtatttatttccc

SEQ ID NO: 641 - DNA, 396 bp, Homo sapiens
atttctgacatcctgaaccatagtaaaagggtgttttttgtttttttgagacagagtcttgctctgttgcctgggctggagtgcagtggtgtgatcttggctcgctgcaacctccgcctcccaggttcaagtgattctcctgcctcagcctcctgagtagctgggattacaggtgcttgccaccacacctggctatttkttgtgtttttagtagagacagggtttcaccatgttggccaggctggtcttgaactcctgaccttgtgatctgcctgcctcagcctcccaaattgctgggattacaaggcgtgttgttttaagccactcagtttgtggccacttgttacagcagcaagaggaaactcatacagttatcatgtgaactcacaggaatat

SEQ ID NO: 642 - DNA, 396 bp, Homo sapiens
gatctgcctgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgagractgtgcccagcatacagtgatcaccctcttagtaagctaagtttctgagcaccagcttttttgagttgactttgttgtctttaacatttgaagatcacccttctttgctcagcctggcttgcagacctgggctgatttgtggatctgatagaaaagtttccttagttgggctcttctccccgaccacccccatgcc

SEQ ID NO: 643 - DNA, 396 bp, Homo sapiens
tgcctcagcctcccaaattgctgggattacaaggcgtgttgttttaagccactcagtttgtggccacttgttacagcagcaagaggaaactcatacagttatcatgtgaactcacaggaatatggtgagttaaaaagagaggaagggtgcaaaacatccacggtagagtgagaactctccagggagtgaggactgtgcmcagcatacagtgatcaccctcttagtaagctaagtttctgagcaccagcttttttgagttgactttgttgtctttaacatttgaagatcacccttctttgctcagcctggcttgcagacctgggctgatttgtggatctgatagaaaagtttccttagttgggctcttctccccgaccacccccatgccagtgtggc

SEQ ID NO: 644 - DNA, 396 bp, Homo sapiens
gctactttgcagccaaggtaactcagacttccctttgttcattctccttctataaagtgcatctcaaggaggttcaaagggcaggctttttgttgaaaggactttgcctgacctctggctcccatctgtgaagccctggagaggtgagagccctcgggaggccgtgtttcaggcatgctctgcacccgtgcagagcgcrtgtgataatgcattgctaatgcttgctccctggtggctggctgagagctgctgtgctgacaagggtggtttaaggctaaatgtgactcagaatccttaagcagtgttagttcagatacaagggcattataaatgagagtgcctgagggatctattttgggaccgctgtcacttggctcttctgctaataagcttcca

SEQ ID NO: 645 - DNA, 396 bp, Homo sapiens
acagttatcagcagcccacaggcttgacttgagcaagttggaaagacaaatcaacttccagagttgatttaacattgagtggaaatcagtcatacttttggtcccctttcggggccacgcctggcactgtgcctggtggcagatcggcatgaactggccagcttctgtggccctggagggcacaggcagaaaggccacrctcagtcccatgatgaactgtttaagacttattgttgtctccccgctctgtaaagtagatagagtggattttatgtcccttattacctttcaggatactttgactcagggagataaagtaacttgggtacagctactcagctggtgaagaacacaggcagaatgagtgcctgggtcttttgacttaaaattctggat

SEQ ID NO: 646 - DNA, 396 bp, Homo sapiens
ctgtgcctggtggcagatcggcatgaactggccagcttctgtggccctggagggcacaggcagaaaggccacactcagtcccatgatgaactgtttaagacttattgttgtctccccgctctgtaaagtagatagagtggattttatgtcccttattacctttcaggatactttgactcagggagataaagtaacttgsgtacagctactcagctggtgaagaacacaggcagaatgagtgcctgggtcttttgacttaaaattctggatttttcacaaagatcctcttactttattcatttacataataaatatatattgaagagctactctgtgccaagccctgtgcctagatatacagtgataaataaagagtagcttctagaggtcacctgg

SEQ ID NO: 647 - DNA, 396 bp, Homo sapiens
aagttcagtgatagagagcagaggtgaggcggcagcagaaaccacttaagggacaccacgtggcactccttctgtgctgagaaggctgtcagtaagctcaccatttatttcctattttctctcctgagttaaataggaaacatgtctcgcattacttgaaaaatcaagtcaaactatgctcttactaggagttatggtyctttttatgtcttagatgatgcttgatctagatgaatgcggacttgctgtagctagataaatacaatgggagtttgaaggtgtttcgtagccctggaaataggtatttcctgtcaaaacaagctttgtcattgccagcagacaaaagcatcagtaaccttggttgataatcgtcatttcttaggaataaagtagact

SEQ ID NO: 648 - DNA, 396 bp, Homo sapiens
gtatttcctgtcaaaacaagctttgtcattgccagcagacaaaagcatcagtaaccttggttgataatcgtcatttcttaggaataaagtagactgtagaattttttttagcagaaaggaaacccaaagataattctagtgcaaatccctcactttatagagcagaagctcaagtcccagaggaacaagtggcttgaaygaacatcagaattttaggggctggatttgtaccctcctggtgccagcagcccacttccctgcaggaggcactcaccttccttgcacaggggtatgagtgtggccattttccacccataatctctgttagctcatgttcaattgggttcccattgaaagaaaaatggaccagtaagttggagcagaatcattcagatg

SEQ ID NO: 649 - DNA, 396 bp, Homo sapiens
agctttgtcattgccagcagacaaaagcatcagtaaccttggttgataatcgtcatttcttaggaataaagtagactgtagaattttttttagcagaaaggaaacccaaagataattctagtgcaaatccctcactttatagagcagaagctcaagtcccagaggaacaagtggcttgaacgaacatcagaattttagkggctggatttgtaccctcctggtgccagcagcccacttccctgcaggaggcactcaccttccttgcacaggggtatgagtgtggccattttccacccataatctctgttagctcatgttcaattgggttcccattgaaagaaaaatggaccagtaagttggagcagaatcattcagatggtataacataaggaaaaa

SEQ ID NO: 650 - DNA, 396 bp, Homo sapiens
tgtttaaattgcttttatatctgtagctctagataacactagttccagcttagttaactcccagctccaagccttcaggacttcatagagttattggggtgctgctcttggcagtttcccaaaaagctagaatgcagagggaatctccttcccaaaaagctagaatgcagagggaatctccttcccaaaaggctagaaygcagagggaatctccttcccaaaaagctagaatgcagagggaatctccttcccaaaaggctagaacgcagagggaatctccttcccaaaaggctagaacgcagagggaatctccttcccaaaaggctagaatgcagagggaatgtccttctcttctaaatggtagctgttagttcaagaaaggttaaacattgtgct

SEQ ID NO: 651 - DNA, 396 bp, Homo sapiens
gctgcgtttgctggactgatgtacttgtttgtgaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagsgggaaggctgactaggacctctgattcttctttccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggc

SEQ ID NO: 652 - DNA, 396 bp, Homo sapiens
gaggcaaaagtactttgtcggttacctaggagagagaacgcagaggtaggtaactgggactactaaagaactgtggagcgattcctgatttttgagcaggaagagtgacaattcaaaacagtatttgactagattcacggctccgtagcatccccttgggtgggagggggaaggctgactaggacctctgattcttctytccctgagctttgaaggctctgaaaatacagctggggggacttgcccagttttcttattaagcaattcctccgcatggtgctggctttcaaagggtgcttcagtgctgtttgctgcacgtgccttgcagccccacaccctgcactcccgccctgcagagtctggcgctggaatgacattttaggtctgggttcccag

SEQ ID NO: 653 - DNA, 396 bp, Homo sapiens
tatctttcagggaccagaagaaagaatgttgggaaaataagatgcagtaagatgcagacatgacagcagggtgcagcggctcacgcctataatcccagcactttgggaggctgaggtgggtggatcacctgaggtcaggagtttgagaccagcctggccaacatggtgaaaccccgtctctactaaaaaatatacaaarcattagccaggcatggtggtgggcgcctgtaatcccagctactccataggctgaggctggagaatcgcttgaacccaggaggcagaggttgcagtgagccgagattgcgccactgcactccagcctgggcaacaaaagcaaaactccatctcaaaaaaaaaaaaaaaaaaaaaaaaaaagatgcagacacgagactg

SEQ ID NO: 654 - DNA, 396 bp, Homo sapiens
tgggcgcctgtaatcccagctactccataggctgaggctggagaatcgcttgaacccaggaggcagaggttgcagtgagccgagattgcgccactgcactccagcctgggcaacaaaagcaaaactccatctcaaaaaaaaaaaaaaaaaaaaaaaaaaagatgcagacacgagactgtgaaactgactagcatcaccwttgcattgtttatagatgttgccagacagaaagccccaaagcagcacagtaccttcctgacatctggactaggaaatctagattttagtaaaatacatgctaatacttacagaagaaatgtcggcgttagagtatgccgtcagttccttagagattgcaattcctaatgcactagtatggtttcaggtgccaggaac

SEQ ID NO: 655 - DNA, 396 bp, Homo sapiens
actccatctcaaaaaaaaaaaaaaaaaaaaaaaaaaagatgcagacacgagactgtgaaactgactagcatcaccattgcattgtttatagatgttgccagacagaaagccccaaagcagcacagtaccttcctgacatctggactaggaaatctagattttagtaaaatacatgctaatacttacagaagaaatgtcrgcgttagagtatgccgtcagttccttagagattgcaattcctaatgcactagtatggtttcaggtgccaggaacacgttctgtgaggctgctgccccaggtgctgaccccagccttccacaccattttccttccttgtgttcacagccgctctgtcttttacaatagcacccctctctagtggctaatgggctctat

SEQ ID NO: 656 - DNA, 396 bp, Homo sapiens
aaaaaaaaaaaaaaaaaaaaaagatgcagacacgagactgtgaaactgactagcatcaccattgcattgtttatagatgttgccagacagaaagccccaaagcagcacagtaccttcctgacatctggactaggaaatctagattttagtaaaatacatgctaatacttacagaagaaatgtcggcgttagagtatgcygtcagttccttagagattgcaattcctaatgcactagtatggtttcaggtgccaggaacacgttctgtgaggctgctgccccaggtgctgaccccagccttccacaccattttccttccttgtgttcacagccgctctgtcttttacaatagcacccctctctagtggctaatgggctctatgattagatagcatcc

SEQ ID NO: 657 - DNA, 396 bp, Homo sapiens
tttcaggtgccaggaacacgttctgtgaggctgctgccccaggtgctgaccccagccttccacaccattttccttccttgtgttcacagccgctctgtcttttacaatagcacccctctctagtggctaatgggctctatgattagatagcatccttcagtagtgataaaggcagtgacatcctagggaggtcagcggktgaaagcgctatatctggaaaacctgagagcctgtgaagctcaaggacttgacggggttagaccgtgagccgggctgcagctggaaaaagaatgactgttctttcagcagatccttccctgtgccatctctttcttcattcctctctagtggcattcttatttatcctctaaaaccacaattccattatctctccta

SEQ ID NO: 658 - DNA, 396 bp, Homo sapiens
gagggtcttctcttttgcctggctccctatgcagccctatcttaccccctgcaaagtcccagggatgtggctcagtcactgctcctctcttcatctgtcaccacttgcttgagatcctacagctgctttaattccgagaccatctgcagaacatgacaaaatttgtccacctacccacatgtccttttaactttaaagrctttactaactgattcctattagggaatgaacagaggtggcaaaaataaacaataggagattgatttacaagaaatctttaaaatagtagatttcttcggacctcattgaaatataaatggcctgccttcttgtgtccctccctggtctccctctttaggtgataagaagaagatcctgccagccccataacccgcc

SEQ ID NO: 659 - DNA, 396 bp, Homo sapiens
ttaaaatagtagatttcttcggacctcattgaaatataaatggcctgccttcttgtgtccctccctggtctccctctttaggtgataagaagaagatcctgccagccccataacccgccatctgcgcgggttctagacccccttctcctcccctctggccgtggtaggcattactgatgaatcatggtgctctttcttmcagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccg

SEQ ID NO: 660 - DNA, 396 bp, Homo sapiens
ctggtctccctctttaggtgataagaagaagatcctgccagccccataacccgccatctgcgcgggttctagacccccttctcctcccctctggccgtggtaggcattactgatgaatcatggtgctctttcttccagagaccaaacctggcctcggaatccttcttaacacagatactgcttaacacaaccactctgrgcagctgtcataagtagaagtaatagatactagaagaaatgtctaagcctaatctagaccaaaatacggcctgatatagatgcaagccagaggggctttatggttaaatgcaaggagattttcaaccctgccgtctagaagctacttgctgagatcttcttcagttgggcccatctcctccccaggcctctcttctg

SEQ ID NO: 661 - DNA, 396 bp, Homo sapiens
ccataacccgccatctgcgcgggttctagacccccttctcctcccctctggccgtggtaggcattactgatgaatcatggtgctctttcttccagagaccaaacctggcctcggaatccttcttaacacagatactgcttaacacaaccactctgagcagctgtcataagtagaagtaatagatactagaagaaatgtmtaagcctaatctagaccaaaatacggcctgatatagatgcaagccagaggggctttatggttaaatgcaaggagattttcaaccctgccgtctagaagctacttgctgagatcttcttcagttgggcccatctcctccccaggcctctcttctgttcctgggctatgtcacacttggactctgcagacacctaatgc

SEQ ID NO: 662 - DNA, 396 bp, Homo sapiens
tggtaggcattactgatgaatcatggtgctctttcttccagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggckttatggttaaatgcaaggagattttcaaccctgccgtctagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctagat

SEQ ID NO: 663 - DNA, 396 bp, Homo sapiens
cagagaccaaacctggcctcggaatccttcttaacacagatactgcttaacacaaccactctgagcagctgtcataagtagaagtaatagatactagaagaaatgtctaagcctaatctagaccaaaatacggcctgatatagatgcaagccagaggggctttatggttaaatgcaaggagattttcaaccctgccgtytagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctagatgagatccttcccccggaatttctctcttgaaccccaga

SEQ ID NO: 664 - DNA, 396 bp, Homo sapiens
gggctttatggttaaatgcaaggagattttcaaccctgccgtctagaagctacttgctgagatcttcttcagttgggcccatctcctccccaggcctctcttctgttcctgggctatgtcacacttggactctgcagacacctaatgctcttgggacctgctttagttcttgacctcaccaaccgaggaggaattgctmgatgagatccttcccccggaatttctctcttgaaccccagatggtccgttgcccctttccagaagttgctccagccctgtccgcttaggaagttcagtgtcatccttgatccagtgggtagggaagacattccataatgaatgccccagtctgagcttcttccttcaggcttcaggctgccctgcgaggattttgca

SEQ ID NO: 665 - DNA, 396 bp, Homo sapiens
gtagctgagactacaggtgtgcactaccacacccagctaattttttgtatttttagtagagatagggtttagctatgttggccaggctggtctcgaactgctgaactcaagcaatctgccatccccggcctcccaaagtactgggagtataggcataagccacccatgatgcccagcctgaatcttggtttcttccccrttcatttaagctattacctgggcctgaactcaatggcacctggcaccaactggcaactgactcttggtcttttattacctaccttccctagcaggcactgggttgctccctcttcctatcccatggagtcctgtcctctgttggggctcctactgatcctcttggcaatatgaagttctcagctcaatggtgggtgg

SEQ ID NO: 666 - DNA, 396 bp, Homo sapiens
cccggcctcccaaagtactgggagtataggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccrtggagtcctgtcctctgttggggctcctactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctgt

SEQ ID NO: 667 - DNA, 396 bp, Homo sapiens
ccggcctcccaaagtactgggagtataggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccayggagtcctgtcctctgttggggctcctactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctgtg

SEQ ID NO: 668 - DNA, 396 bp, Homo sapiens
ggcataagccacccatgatgcccagcctgaatcttggtttcttccccattcatttaagctattacctgggcctgaactcaatggcacctggcaccaactggcaactgactcttggtcttttattacctaccttccctagcaggcactgggttgctccctcttcctatcccatggagtcctgtcctctgttggggctccyactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctgtgccaggtaccaggtcagttgctgaagga

SEQ ID NO: 669 - DNA, 396 bp, Homo sapiens
cctggcaccaactggcaactgactcttggtcttttattacctaccttccctagcaggcactgggttgctccctcttcctatcccatggagtcctgtcctctgttggggctcctactgatcctcttggcaatatgaagttctcagctcaatggtgggtgggcaatgactgccaactcttgaggccaatgaactcaggttwccccactcctcctcctcctgagttgctcactcactcctcattcactcaacattgattcagtagatatttgctacctgctctgtgccaggtaccaggtcagttgctgaaggagtaacagtgaacatgacggagtctttgtccccaaggagacccaaggtgtctcctagagccaggggcacattgcaagaccaaatata

SEQ ID NO: 670 - DNA, 396 bp, Homo sapiens
ctggcaactgactcttggtcttttattacctaccttccctagcaggcactgggttgctccctcttcctatcccatggagtcctgtcctctgttggggctcctactgatcctcttggcaatatgaagttctcagctcaatggtgggtgggcaatgactgccaactcttgaggccaatgaactcaggttaccccactcctyctcctcctgagttgctcactcactcctcattcactcaacattgattcagtagatatttgctacctgctctgtgccaggtaccaggtcagttgctgaaggagtaacagtgaacatgacggagtctttgtccccaaggagacccaaggtgtctcctagagccaggggcacattgcaagaccaaatatattcaacttacc

SEQ ID NO: 671 - DNA, 396 bp, Homo sapiens
ccatggagtcctgtcctctgttggggctcctactgatcctcttggcaatatgaagttctcagctcaatggtgggtgggcaatgactgccaactcttgaggccaatgaactcaggttaccccactcctcctcctcctgagttgctcactcactcctcattcactcaacattgattcagtagatatttgctacctgctctrtgccaggtaccaggtcagttgctgaaggagtaacagtgaacatgacggagtctttgtccccaaggagacccaaggtgtctcctagagccaggggcacattgcaagaccaaatatattcaacttaccaaaataatcatagacctagttctcaaaaagcaagaagactgattcctcgttgtcatttctcctcctcagca

SEQ ID NO: 672 - DNA, 396 bp, Homo sapiens
ttagagtctgtgggcccctccaagtgtggagtatggtgttacttcaccagagtttgaggagaaacattcttcttttggaaggccggggagcatagatggatatcaaggctgctgtttctaaaagcgaaacccaccaaacaacagtattagaatcatctgtggtgcttattaaagatacagattcctgggccccatcccmgacttatgaatcagaatctctgccagaggaagcctgagaatttgcattctcagatgattctgcattctcagataacacattctttaggtgattcttacacacactggagtttgggaatcgctgaaggctgttcacttctcttttctgagaaatgattcattcatttcagaaatatttgcagaggtccttatttattg

SEQ ID NO: 673 - DNA, 396 bp, Homo sapiens
tggcctcattcgtgtgataaatctgagccaccacgatatttgacttttcacaatttaatttatctgaaccctctattctctggctaaaaaatatcccttacttggacttctttattttattttcaattcccttaccagcactagcaggggactctgtactcatctgctggcgctgccataacaaagcactgcagcctgkggggctcaaaccacagaatttattctctcacagtcctagaggctagaagtccaagatcaaagtgtgggcagggtcggtttctcctgcagcctctctccttggcttatagagtgccaccttctacctgtgtcttcacatcatcacctcactgagcatgtctgtgtccaaatctccccttcttataagaccccagtcat

SEQ ID NO: 674 - DNA, 396 bp, Homo sapiens
tctccttggcttatagagtgccaccttctacctgtgtcttcacatcatcacctcactgagcatgtctgtgtccaaatctccccttcttataagaccccagtcatactggatgaggatccacccatatgagttcattttaccttaattatctctttaaacaccctgtctccaaatacagtcccattctgaggaactgagrgtaaagattcaacatatgaattttggaagggacctaattcagcccacaacaccctcttttgggatgtttattttcccccttaaggagctagttaggatgtcttatctcatgaacatgactgtgaacaggaaaacagggagagaatgaagctggccaaggaacagggctggtgtcagctagcagtgcttttctgatgt

SEQ ID NO: 675 - DNA, 396 bp, Homo sapiens
cattttaccttaattatctctttaaacaccctgtctccaaatacagtcccattctgaggaactgagagtaaagattcaacatatgaattttggaagggacctaattcagcccacaacaccctcttttgggatgtttattttcccccttaaggagctagttaggatgtcttatctcatgaacatgactgtgaacaggaaracagggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggctgatgctgctggtccacggaccatactttg

SEQ ID NO: 676 - DNA, 396 bp, Homo sapiens
gggagagaatgaagctggccaaggaacagggctggtgtcagctagcagtgcttttctgatgtgagtgggtcccacagggagcttgttaaaatgcagattctgattcattaggttccagagggacctgagatttcccatttctgacaagtttccagtgtgggggctgatgctgctggtccacggaccatactttgagtakcaaggagcttgatacataatggctgagtgactttcagactcctgctgtagaaaaattatgagttggctgggcgtggtggctcacgcctgtaatcccagcactttgggaggccgaggtgggcagatcacctgaggtcaggagttcgagaccagcctggccaacatggtgaaacaccatctctaccaaaaatacaaaaa

SEQ ID NO: 677 - DNA, 396 bp, Homo sapiens
acttaagcccagaagactgaggttgcagtgagccgagattgcaccactgcactccagcttgggctacagagtgagactctatctcaaaaacaaagaaacaaacaacaacaataacaacaaaaaccaagtctctccctccactcaaaaatgcaagggcctgtctcccattgctgggtgcccaggtctcatgaatgtagayatgaattattccagtcagcctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtc

SEQ ID NO: 678 - DNA, 396 bp, Homo sapiens
ctcaaaaacaaagaaacaaacaacaacaataacaacaaaaaccaagtctctccctccactcaaaaatgcaagggcctgtctcccattgctgggtgcccaggtctcatgaatgtagatatgaattattccagtcagcctcaggagaatagaatgagccctcagatgccgaagcacctttcagattccaccggttttatcrgctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcaga

SEQ ID NO: 679 - DNA, 396 bp, Homo sapiens
tgtagatatgaattattccagtcagcctcaggagaatagaatgagccctcagatgccgaagcacctttcagattccaccggttttatcggctcatttaaacttcacttctaacacagtcctgcattacacacgtgtctgtcgttatgggcagctgcagagagggtcttaatggtcctaatgctcagtgaggatgcccartggtcaacagaacctgccatcttcaggccatcaaggagctctggagttaaggaaatcatgagagcacagaggggcgggtacagcagagccctcgtggtaatgggttttgaggtctaggctctcttcacttgggtttgaaataagttcaatgactagtaatagctgagacacttctacccttcaaatgaagtaaatgg

SEQ ID NO: 680 - DNA, 396 bp, Homo sapiens
agcacctttcagattccaccggttttatcggctcatttaaacttcacttctaacacagtcctgcattacacacgtgtctgtcgttatgggcagctgcagagagggtcttaatggtcctaatgctcagtgaggatgcccaatggtcaacagaacctgccatcttcaggccatcaaggagctctggagttaaggaaatcawgagagcacagaggggcgggtacagcagagccctcgtggtaatgggttttgaggtctaggctctcttcacttgggtttgaaataagttcaatgactagtaatagctgagacacttctacccttcaaatgaagtaaatgggaaaatggagcattgttgagtccagggagctataatttaaaccccatatatctaaaagg

SEQ ID NO: 681 - DNA, 396 bp, Homo sapiens
cacacgtgtctgtcgttatgggcagctgcagagagggtcttaatggtcctaatgctcagtgaggatgcccaatggtcaacagaacctgccatcttcaggccatcaaggagctctggagttaaggaaatcatgagagcacagaggggcgggtacagcagagccctcgtggtaatgggttttgaggtctaggctctcttcrcttgggtttgaaataagttcaatgactagtaatagctgagacacttctacccttcaaatgaagtaaatgggaaaatggagcattgttgagtccagggagctataatttaaaccccatatatctaaaaggggtaacatttttgtgtgtgtgaaattggtgtcattcgcactgcatctacagttttctttttccttctc

SEQ ID NO: 682 - DNA, 396 bp, Homo sapiens
acatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctayaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcactta

SEQ ID NO: 683 - DNA, 396 bp, Homo sapiens
tggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccrtgcattttgtttgtttcttcacttatcctgttctctgaagatgttttgtgaccaggtttgtgttttcttaaaataaaatgcagagacatgttttaagctgatagttgaggggttttgttaatggcttttgggggatttatctctatacccacaaacgactagtttgttttcctcaaactaaatgataatattaaaaa

SEQ ID NO: 684 - DNA, 396 bp, Homo sapiens
ttatctctatacccacaaacgactagtttgttttcctcaaactaaatgataatattaaaaatacacatcctggccaggtgtggtggctcatacctgtaatcccagcactttgggaggccgaggcaggtggatcacttgaggtcaggaattaagaccagcctggccaatatggtgaaagcctgtctgtactaaaaatacraaaattagccaggtatgctggtggatgcttataatcccagctacttgggaggttgaggcaggagaattgcttgaacccgggaggtagaggttgcagtgagccaagatcatgccactgcactccagcttgggcaacagagtgagactccatctcaaattaaaaaaaatacacatctggcttctggaaaaattacttga

SEQ ID NO: 685 - DNA, 396 bp, Homo sapiens
gatcatgccactgcactccagcttgggcaacagagtgagactccatctcaaattaaaaaaaatacacatctggcttctggaaaaattacttgaagatcttttatgacatccatccctcttcacacagccatgtgaattaggttggtatcttcatatactagcatcgtgcccagcacttccatgttatacagtttaaaakgttctgtaattccctgtgggaacctaagataatgcgaggaccgtcatacgtgcccccaaatattggcaaaccaatgaataaatgaatgaatgagtttatgaatcgctaactggctgtatttaatgaagtatgtgtgttgagccatttcccacagtgtggacagatttgtcccacaatatgggcctcttcccaaaggc

SEQ ID NO: 686 - DNA, 396 bp, Homo sapiens
aattaaaaaaaatacacatctggcttctggaaaaattacttgaagatcttttatgacatccatccctcttcacacagccatgtgaattaggttggtatcttcatatactagcatcgtgcccagcacttccatgttatacagtttaaaatgttctgtaattccctgtgggaacctaagataatgcgaggaccgtcatacrtgcccccaaatattggcaaaccaatgaataaatgaatgaatgagtttatgaatcgctaactggctgtatttaatgaagtatgtgtgttgagccatttcccacagtgtggacagatttgtcccacaatatgggcctcttcccaaaggccctaccacctaatgccatcacactggggatttgatttcaacatgtgaatt

SEQ ID NO: 687 - DNA, 396 bp, Homo sapiens
agttcatagtgacagtgatccagccactgtcatgacaggtgccacttggcagaaacagcacagcttggaagatggcggggtgtagtcaagattccaggatccccaacagagaagccagctcttataggggagccattcatcaggattgaactctcaatcgagctggacagtaataggtgggtctgtgttattccccagrtgagtatcatgacagtcacaatcctaggaaggatgtgaagcctcccccagctctcctccagttgcctgcttgggcagcagagatgatggaatgtggagtctggcgtggtctgaggcctgaatccatgtgcctcatgtatgatgctcaggcaagaggatctctcaattcaagggagagggcctgaatgagccttgctt

SEQ ID NO: 688 - DNA, 396 bp, Homo sapiens
cttggcagaaacagcacagcttggaagatggcggggtgtagtcaagattccaggatccccaacagagaagccagctcttataggggagccattcatcaggattgaactctcaatcgagctggacagtaataggtgggtctgtgttattccccagatgagtatcatgacagtcacaatcctaggaaggatgtgaagcctyccccagctctcctccagttgcctgcttgggcagcagagatgatggaatgtggagtctggcgtggtctgaggcctgaatccatgtgcctcatgtatgatgctcaggcaagaggatctctcaattcaagggagagggcctgaatgagccttgctttccaggcctgtctgatggtccaggctgaagcccctcctggcttg

SEQ ID NO: 689 - DNA, 396 bp, Homo sapiens
ctggcgtggtctgaggcctgaatccatgtgcctcatgtatgatgctcaggcaagaggatctctcaattcaagggagagggcctgaatgagccttgctttccaggcctgtctgatggtccaggctgaagcccctcctggcttgcactgccagacctcatccagcaggagctccttggcattgactgcttcaggatagttscttctgctctgagtgctctctaaagagcagtgctctaccatccaagctgggcttttcttttcttcttgctgatagggaaggcatgggacattgcaggatggaagtggcccccaggccttctcatgcctgggcttggtttggaaggtggtcaggtgatcaataatcctgattggcctggcattgaggagttttcctgg

SEQ ID NO: 690 - DNA, 396 bp, Homo sapiens
tgctctctaaagagcagtgctctaccatccaagctgggcttttcttttcttcttgctgatagggaaggcatgggacattgcaggatggaagtggcccccaggccttctcatgcctgggcttggtttggaaggtggtcaggtgatcaataatcctgattggcctggcattgaggagttttcctgggatgtggtcctttcrgttttttaaaaattatttttattgatacacatatttgtaggtatttgtggggtgcatgtgatactttattatgtgtgtggattgtgtaatgatgaagtcagggcatttagggtcttcatcaccttgattatcatttctatgtgttgagaacatttcaagttctcagttccagctattttgaaatagacagtccattt

SEQ ID NO: 691 - DNA, 396 bp, Homo sapiens
gatactttattatgtgtgtggattgtgtaatgatgaagtcagggcatttagggtcttcatcaccttgattatcatttctatgtgttgagaacatttcaagttctcagttccagctattttgaaatagacagtccattttgttagctacagtcacccaacccggctgtcagacattggaacttactcctattgaactgtrtatttgtacccattcaccaaactctctttgggctttcagttttacaactgggatgatcctgggaaaactaaagtaaatcagacacccgacgtgtgagctaggttataatatgcccagtggaccctggggacatcttagctttcagaggtcatgctgtccaagctgactgtggggcttccagaaggtggggagaggaa

SEQ ID NO: 692 - DNA, 396 bp, Homo sapiens
tatgtgtgtggattgtgtaatgatgaagtcagggcatttagggtcttcatcaccttgattatcatttctatgtgttgagaacatttcaagttctcagttccagctattttgaaatagacagtccattttgttagctacagtcacccaacccggctgtcagacattggaacttactcctattgaactgtgtatttgtacycattcaccaaactctctttgggctttcagttttacaactgggatgatcctgggaaaactaaagtaaatcagacacccgacgtgtgagctaggttataatatgcccagtggaccctggggacatcttagctttcagaggtcatgctgtccaagctgactgtggggcttccagaaggtggggagaggaaatgatgcaat

SEQ ID NO: 693 - DNA, 396 bp, Homo sapiens
tgggaaaactaaagtaaatcagacacccgacgtgtgagctaggttataatatgcccagtggaccctggggacatcttagctttcagaggtcatgctgtccaagctgactgtggggcttccagaaggtggggagaggaaatgatgcaatggcccatcagaggcactacttggggcctggggccagagtgcatgtctaagscattaaggggaggggagagcagccttcataattatgaagaggagtctcaggtgcacagcttctgatgagggacagcttctaattgaagacagcattgtgtaatgctcaaactccctgtcttcagagtgcctgctgtatcccaccatcagttctgtgacttctccctaagcctcaattttgcatgtgttacattggga

SEQ ID NO: 694 - DNA, 396 bp, Homo sapiens
cctgcatagcaaattcttgcaaatgtagggactcaaaacaatataaatttattatctgacagtttttctgggtcagaggtcttactaggctgtaatcagagggcaaccaaagctgtgatctcagctgaagctcaggattctcttccaagctcactggttgttggcagaattcagttctttccagttggaagactaaagyctacagtcttcagtctctagaagccttttctctggcacaggtttctctacaacatggccatttatgtctttaaggccaataggagaacatgattagcatattttttttaagtgaactttagacccttttttaaaggcctatctgattaggccaggcccaagtgagctttaagtcaactgattagagatcttaattac

SEQ ID NO: 695 - DNA, 396 bp, Homo sapiens
ctgaagctcaggattctcttccaagctcactggttgttggcagaattcagttctttccagttggaagactaaagcctacagtcttcagtctctagaagccttttctctggcacaggtttctctacaacatggccatttatgtctttaaggccaataggagaacatgattagcatattttttttaagtgaactttagacycttttttaaaggcctatctgattaggccaggcccaagtgagctttaagtcaactgattagagatcttaattacatctgcaaagtcccttcatgtttaccgtataacataacttagtgaaaggagtgaaattgcaaccaggttctgcctgcactccacggaaggggattctgcagaagtgtgggtcacgggggggtta

SEQ ID NO: 696 - DNA, 396 bp, Homo sapiens
agaacatgattagcatattttttttaagtgaactttagacccttttttaaaggcctatctgattaggccaggcccaagtgagctttaagtcaactgattagagatcttaattacatctgcaaagtcccttcatgtttaccgtataacataacttagtgaaaggagtgaaattgcaaccaggttctgcctgcactccacrgaaggggattctgcagaagtgtgggtcacgggggggttattttgggattctgcctacgtcactgagtcaaaagaagctgaatggttgtgatgctgaggtttttgggcagcagcagtgtgtgtgtgtgagtgaattcatacgtatgaccacctgggaagaaaggaggctgtggtttcctccacctcctggcagacaga

SEQ ID NO: 697 - DNA, 396 bp, Homo sapiens
gggattacagacacacactgccacgcctggctaatttttgtatttttagtagagacgaggttttgccatgttggccaggctggtcttgaactcctgacctcaagtgatccgcccacctcagcctcccaaagtgctgggattacagacgtgagccaccattaaccatttttctatctcctgtgggaaagggcacagtgaragaacagatgaagctgagacatacaagtgaactcctccctcctctccatttagactaaaataggattattcatactgagattctccctggttgcaaagagataatctgtgcaactgggtttttacaattatccctaccctatgctttcctcatctgtcttcctcgtagtcagctcaggctgctataacaaaacacca

SEQ ID NO: 698 - DNA, 396 bp, Homo sapiens
ggcagattcggtgtctaatgaggtcctgctttccagtttatagacagtgccttatcgctaccgccttacacagtggaaggagaggacgagaagctccttgggcttttttttgtttctttctttctctctctctctcttttttttttttttaataaggtcactatcttagtccattttgtgttgctaaaaggaacatctraggttgagtaatttattttattttaaaaagtggccaggcatggaggcttatcctgtaaccctaatcctttaggaggccaaaacagcaggattgtttgaggccaggagttcaagaccagcctaggcaagatagtgagaccccatctaccccatctctactaaaattttaaaaaattagctgtgtgttgtaaagtgtgc

SEQ ID NO: 699 - DNA, 396 bp, Homo sapiens
aatttattttattttaaaaagtggccaggcatggaggcttatcctgtaaccctaatcctttaggaggccaaaacagcaggattgtttgaggccaggagttcaagaccagcctaggcaagatagtgagaccccatctaccccatctctactaaaattttaaaaaattagctgtgtgttgtaaagtgtgcttgtagtcccrgccacttgagaggctgaggtgggtggagttcaaggctgcagtgagttatgattgagccactgcactccaacccgggtaacggggcaagaccttgtctctatttaaaaaaaaaaaatctttatgtggctcactattctgggtggctggaaagttcaagattgggcatctgcatctggtgacagcctcatgtcgcttcc

SEQ ID NO: 700 - DNA, 396 bp, Homo sapiens
taaccctaatcctttaggaggccaaaacagcaggattgtttgaggccaggagttcaagaccagcctaggcaagatagtgagaccccatctaccccatctctactaaaattttaaaaaattagctgtgtgttgtaaagtgtgcttgtagtcccggccacttgagaggctgaggtgggtggagttcaaggctgcagtgagwtatgattgagccactgcactccaacccgggtaacggggcaagaccttgtctctatttaaaaaaaaaaaatctttatgtggctcactattctgggtggctggaaagttcaagattgggcatctgcatctggtgacagcctcatgtcgcttccagtcatgggggaagacgaaggagagctggcacgtgcagatatcacg

SEQ ID NO: 701 - DNA, 396 bp, Homo sapiens
atcctttaggaggccaaaacagcaggattgtttgaggccaggagttcaagaccagcctaggcaagatagtgagaccccatctaccccatctctactaaaattttaaaaaattagctgtgtgttgtaaagtgtgcttgtagtcccggccacttgagaggctgaggtgggtggagttcaaggctgcagtgagttatgattragccactgcactccaacccgggtaacggggcaagaccttgtctctatttaaaaaaaaaaaatctttatgtggctcactattctgggtggctggaaagttcaagattgggcatctgcatctggtgacagcctcatgtcgcttccagtcatgggggaagacgaaggagagctggcacgtgcagatatcacgtgttgagg

SEQ ID NO: 702 - DNA, 396 bp, Homo sapiens
ttaaaaaattagctgtgtgttgtaaagtgtgcttgtagtcccggccacttgagaggctgaggtgggtggagttcaaggctgcagtgagttatgattgagccactgcactccaacccgggtaacggggcaagaccttgtctctatttaaaaaaaaaaaatctttatgtggctcactattctgggtggctggaaagttcargattgggcatctgcatctggtgacagcctcatgtcgcttccagtcatgggggaagacgaaggagagctggcacgtgcagatatcacgtgttgagggcagaagcgagagagagaggggagagatgccaggctctttttaacaaccagcactggggaaactaatagagtgagagctcactgactcctgagggaggacat

SEQ ID NO: 703 - DNA, 396 bp, Homo sapiens
atgggggaagacgaaggagagctggcacgtgcagatatcacgtgttgagggcagaagcgagagagagaggggagagatgccaggctctttttaacaaccagcactggggaaactaatagagtgagagctcactgactcctgagggaggacattaatctattgatgagcgacctgcctccatgacccaaacacctccaaygataccccacctccaacactgccacactagggattaactttcaacttgagatttagaggggggaaacttacaaactatcgcaggcactaataccactcatgagggctccaccttcatgacctaatcacttcctaaaggccttacctcttaatctcatcacattgaggattcgatttcaacttgaattttggggggac

SEQ ID NO: 704 - DNA, 396 bp, Homo sapiens
ctcgctgccacctgaaattagatcatttatttacccctttatttgttcagtttgccttgtccgttagaatataagcttccaaagggcaggagctttgcctatattgttaggccgggcatacaatgagcactcaaaaaaatatttgatgagtgtatgaaagaacagactgggttatgtaattgtgcctacttacctataygaccgtgtggtggggtttatggtgggtgtggtggtgatggctatagggctataagcaaatttgggacagggagtctaagaaatgttcttaaattttagtaagcaaagcatcctctacagaacctgtcttaaaacatgaaagttccttagtgctacccccagaggtatgatttggtaggtcaaggatagggcctggaa

SEQ ID NO: 705 - DNA, 396 bp, Homo sapiens
tgccacctgaaattagatcatttatttacccctttatttgttcagtttgccttgtccgttagaatataagcttccaaagggcaggagctttgcctatattgttaggccgggcatacaatgagcactcaaaaaaatatttgatgagtgtatgaaagaacagactgggttatgtaattgtgcctacttacctatatgaccrtgtggtggggtttatggtgggtgtggtggtgatggctatagggctataagcaaatttgggacagggagtctaagaaatgttcttaaattttagtaagcaaagcatcctctacagaacctgtcttaaaacatgaaagttccttagtgctacccccagaggtatgatttggtaggtcaaggatagggcctggaaattca

SEQ ID NO: 706 - DNA, 396 bp, Homo sapiens
cctgtcttaaaacatgaaagttccttagtgctacccccagaggtatgatttggtaggtcaaggatagggcctggaaattcacattcttgttaagatgttcttcatccggggtttgttgaccaccttttcagaagatttttgctctgtagctgtactacccaatgcagtagttcgtagtcagtgtggctcctgagccctygaagtgtagctcctctgaactgagacgtgctgtaaatgtaaattgcacaccggagtttgaagagttaatacaaagaaaaaggaatgcaaaacatctcattaataatgctttacactgattacatattgaaatggtaatcttgtagatatagtgcgttaaataaaatatactgttaggcttaatttcacgtctttata

SEQ ID NO: 707 - DNA, 396 bp, Homo sapiens
tcagccaatcaacaagagggcaaaagaacaaacatttgatgtgtaattacttaatttagtgcatatgcatttgggtcctcaatgtcagcactatggcaaccagaacatggccacaataactgtctggaaatgtctattcttacctggacccagcaggccatgccccactgattatataatctccctctctccttgttayggtctgaatgcttgcatccctcaaaaattcatgtgttgaaatcctaacccccaaggtgatgatattaggaggtcggccttttgagaggtaattaggtcatgaagacagcatcctcatgaatgggattagtgtccttataaaataggcccaagggagctcattcactttgtccaccatgtgagaacacagcgagaggg

SEQ ID NO: 708 - DNA, 396 bp, Homo sapiens
ccttgttacggtctgaatgcttgcatccctcaaaaattcatgtgttgaaatcctaacccccaaggtgatgatattaggaggtcggccttttgagaggtaattaggtcatgaagacagcatcctcatgaatgggattagtgtccttataaaataggcccaagggagctcattcactttgtccaccatgtgagaacacagygagagggcaccatttatgcaccaggaaatgggccttttccagacaatctgtcggtgcctggatcttggacttcacagcctctagaactgtgagaaattaatttgttttttataagccaccaaatctatggttttttttatagaaaccgtaatggactaaaacactccctaattatatttaaacttatcagtgcactg

SEQ ID NO: 709 - DNA, 396 bp, Homo sapiens
ctaacccccaaggtgatgatattaggaggtcggccttttgagaggtaattaggtcatgaagacagcatcctcatgaatgggattagtgtccttataaaataggcccaagggagctcattcactttgtccaccatgtgagaacacagcgagagggcaccatttatgcaccaggaaatgggccttttccagacaatctgtyggtgcctggatcttggacttcacagcctctagaactgtgagaaattaatttgttttttataagccaccaaatctatggttttttttatagaaaccgtaatggactaaaacactccctaattatatttaaacttatcagtgcactgggcagtgacatattaaaagaatgctggccaacgtaattgacaccataaggct

SEQ ID NO: 710 - DNA, 396 bp, Homo sapiens
tcatctcattttaaccttttgtttcaaagcctctcttttcatgacttccccgccttcatttttcccatatggtggggttattattaagacattaaatgagagtggacaggtaggcaaaggaggtgggttgcaggggagttgagggttgcctgtgtacttttctagactgttccacttcacatcagtgaaatattcccarttgatactatcatgaaacaaagcaaatgaaatgctgagcacggagcttcgtcttgatgaaatgctgaaagaaaagaaaggaaaaataaagtagccattatttttgcccttcctcccacccccatgtttactactcttatttctcttttgtattgttgtgttggaagcacagcatcagaaaaactcccagttttgaga

SEQ ID NO: 711 - DNA, 396 bp, Homo sapiens
acaggtaggcaaaggaggtgggttgcaggggagttgagggttgcctgtgtacttttctagactgttccacttcacatcagtgaaatattcccaattgatactatcatgaaacaaagcaaatgaaatgctgagcacggagcttcgtcttgatgaaatgctgaaagaaaagaaaggaaaaataaagtagccattatttttrcccttcctcccacccccatgtttactactcttatttctcttttgtattgttgtgttggaagcacagcatcagaaaaactcccagttttgagagataactcagtgtttagttcacttaaacctgagaaaggagaagaggatgccaccgtgaggtccaggacgtaaagaggaaaaaaacagacaaaaaaatccatatga

SEQ ID NO: 712 - DNA, 396 bp, Homo sapiens
caggtaggcaaaggaggtgggttgcaggggagttgagggttgcctgtgtacttttctagactgttccacttcacatcagtgaaatattcccaattgatactatcatgaaacaaagcaaatgaaatgctgagcacggagcttcgtcttgatgaaatgctgaaagaaaagaaaggaaaaataaagtagccattatttttgmccttcctcccacccccatgtttactactcttatttctcttttgtattgttgtgttggaagcacagcatcagaaaaactcccagttttgagagataactcagtgtttagttcacttaaacctgagaaaggagaagaggatgccaccgtgaggtccaggacgtaaagaggaaaaaaacagacaaaaaaatccatatgaa

SEQ ID NO: 713 - DNA, 396 bp, Homo sapiens
ttcgtcttgatgaaatgctgaaagaaaagaaaggaaaaataaagtagccattatttttgcccttcctcccacccccatgtttactactcttatttctcttttgtattgttgtgttggaagcacagcatcagaaaaactcccagttttgagagataactcagtgtttagttcacttaaacctgagaaaggagaagaggaygccaccgtgaggtccaggacgtaaagaggaaaaaaacagacaaaaaaatccatatgaaatgaaaatgtgaaagaggcgctttcgagcagatgagtgttgtagattacagtgttgagagctgtttgtgtccagagctgcttgctgcacctggcgggataaacactggtctaacagaggatccttgtttcaaggaggct

SEQ ID NO: 714 - DNA, 396 bp, Homo sapiens
aagaaaagaaaggaaaaataaagtagccattatttttgcccttcctcccacccccatgtttactactcttatttctcttttgtattgttgtgttggaagcacagcatcagaaaaactcccagttttgagagataactcagtgtttagttcacttaaacctgagaaaggagaagaggatgccaccgtgaggtccaggacrtaaagaggaaaaaaacagacaaaaaaatccatatgaaatgaaaatgtgaaagaggcgctttcgagcagatgagtgttgtagattacagtgttgagagctgtttgtgtccagagctgcttgctgcacctggcgggataaacactggtctaacagaggatccttgtttcaaggaggctgccttttatttggggggacaa

SEQ ID NO: 715 - DNA, 396 bp, Homo sapiens
attatttttgcccttcctcccacccccatgtttactactcttatttctcttttgtattgttgtgttggaagcacagcatcagaaaaactcccagttttgagagataactcagtgtttagttcacttaaacctgagaaaggagaagaggatgccaccgtgaggtccaggacgtaaagaggaaaaaaacagacaaaaaaayccatatgaaatgaaaatgtgaaagaggcgctttcgagcagatgagtgttgtagattacagtgttgagagctgtttgtgtccagagctgcttgctgcacctggcgggataaacactggtctaacagaggatccttgtttcaaggaggctgccttttatttggggggacaaaattgttcttgaaagctgctcagtggtt

SEQ ID NO: 716 - DNA, 396 bp, Homo sapiens
tttgtattgttgtgttggaagcacagcatcagaaaaactcccagttttgagagataactcagtgtttagttcacttaaacctgagaaaggagaagaggatgccaccgtgaggtccaggacgtaaagaggaaaaaaacagacaaaaaaatccatatgaaatgaaaatgtgaaagaggcgctttcgagcagatgagtgttrtagattacagtgttgagagctgtttgtgtccagagctgcttgctgcacctggcgggataaacactggtctaacagaggatccttgtttcaaggaggctgccttttatttggggggacaaaattgttcttgaaagctgctcagtggttcaagctacagcatggtggactagcagaatggactccagggcctccgagga

SEQ ID NO: 717 - DNA, 396 bp, Homo sapiens
ttttgagagataactcagtgtttagttcacttaaacctgagaaaggagaagaggatgccaccgtgaggtccaggacgtaaagaggaaaaaaacagacaaaaaaatccatatgaaatgaaaatgtgaaagaggcgctttcgagcagatgagtgttgtagattacagtgttgagagctgtttgtgtccagagctgcttgcygcacctggcgggataaacactggtctaacagaggatccttgtttcaaggaggctgccttttatttggggggacaaaattgttcttgaaagctgctcagtggttcaagctacagcatggtggactagcagaatggactccagggcctccgaggagacagtgactgctgccagaaatagtcaaggatagaaaggaagga

SEQ ID NO: 718 - DNA, 100001 bp, Homo sapiens
taaggcatatcatgcaaagtaaaattagccaaagaaagtcaactggtggagagcttgttgaagcaaatttaaaaaaaaaaaaaaaggttaacaaaagtctaatgtttttagaaaaaattgctatcaatctgtttccaaatttgaattcatctaatgctaagagtaaaaaacaggcacatacaattgtggttattcttctcacccttaagagtgagtggcctgttgaaactgttaagaaagaaagaaaagttttataatctgaaaatacctggtgggtcttgaaccacgacaacaggaacacagtgctgaatttagcaactataatactgccatcagcctaaccaacgtaggctttagaagaactgaatgatacaatggattgatctacctaggaaagttctcaggtctctccttcagcctagtattgctttgtgctaaactgactgccctctcatctgctacttcatgacaaagcccattaaaggtcctcagactccgggattttggtggatttcttgtgcagaaattgcagtgaaaaggctgttggagaaagaggtcttgattctggaatatgctccattctgtatttttcaatgtatggagcagctacttcccaaacctgaaaagcaaggacaaaacaaagttgaaatattgacgacattgtttccacatgctattaaacatcaacttcatccgaagtcaaaacatactctatacatgaccagacacagctgctgtttgcttgcttttattttaagccatttgacacatgacctgtgtcaattagtctttggttgcattaaagactgtaaatatacaaagtccaaaactttctaaagtcatcataaagattttaagctgcatacttttcctaagcaaaacaagcaagcaaataacaaaacccagagaattcagtgtggatagagtgaaggatagttgctccagggtcttaacagtacctatgtggtttttttcttgtttttttgttttttttctttttttgtgagacagagtctcactctgtcgcccaggctggagtgcagtagcatgatctcagctcactgcaacctccaccttccaggttcaagcaattcttgtgcctcagcctcctgagtagctgggattacaggtgcatgccaccaggcccagctaatttttgtatttttagcagagatggggtttcaccatgttggccaggctggtctcgaatttctggcctcaagtgatccacccaccacagcttcccaaagtgctgggattacaggcgtgagccaccacacatggcctggacctgtgtgttttctaaagcaagccttaaatggtaaaaggcagtgaattgtatttccctattgccttatttccatgccacaggtgctctgttcctttgaccctgctactcaaagcgtggcctgtgcccctgcagtatcagcatcacctgggacaagtcagaatcttggccttcacccagacctactgaatccacacctgcattttaacaagatgcccagcagattcatagccactttaatgttggagaggcactgcctcagatccttggttagcttttgcctcccacccaccaacctcttttttctttttttttttttttcttaagcataacatcatctcaaagtaaggccctggacgggcatggtggcatgtgcctgtagtcccagctactcaagaagccaaagtgggaggatcacttgagcccaggagtttgagtccagccttggcaacatagcaagacccgcatctctaaaaaaatttttttttaaattgaatgaaattaaggccctgtttttggtttatatctgctttttaactgattgccactgacagccaaggagcctttcctattattttttatgaccttagcaaatgaatactcttaaaggctaacctctcgtatacctccctcctagcaccaaagttggcagcaggcaagcagcttccccatccagagtgcagggcatgcttagaaataatgggtgtgaaaatcacagggaaaaatcactgccccagagcagagcaactgttttaaggaaatcaagcgattctagggaacataacacccacaagttattcaaaaggtttaaagcacttcaaaaacgatatttaaaagataagccagcatgctgggcatctgtacctggcagctgagtatacggtcaatgtaaccagtggaaatatgcaagaaagaaaaacccgcatctcaccagagcactagacagaccgaaagtcttctgaagtaaacacccgggccttggttttctctccaggtctacgcagccattgcacccagtggtggtagttgtgatagcatcacccagaagggaacgcacttttgaatcaaagaggacatcttgcaggggtggggaggcatcaatgaacctgacatcttatttttttccccatgaatattgtcccaaaactccatttaaaatccatttctgtttctaatccttagatattcaaccgttggctgcaccctggtgcacttagtgtttattatatggcttcttagtggtgctgcaagttgttgctcaaatacctttttgctcattcccaaggaatggccagaaaacaatagaataaggcaatgtttctccatccccgactttgctttcctgtaacaattaaaaattaagaaacaagccaaggagccagcttgccttctgctccaggagcagcctgtgggctgcctcgatgtccggggccatgaagcgatcttttatccagggcctacagggagagcacatccgcccatcagccaaacatgaaaccctgccagggttcacagtgctgaactgatgtaattttcagagacctgtttgatcttaccttacaacagagcgcaccaggtcatagaccttctccagcggagtggttgttttcaggggacgtagaaactctatgccctggcaggctgcaaggagctcgatggccagcactgaaacaagaaattccaagagggtagcttatgaaagtctgacttcatgcttaaggaatgtggatttcccaaagttgacacccatcaccacccaactaacagatggtttgttctctgtctattggtagaatgaagttgctttggtatttagttgccattttaacctgttttctaaccccttgactatatctttaatgctgagaaggggagaattgagacatttacctgaataattaccagacctgcacacctacccaggaagctgcccattcatctgcactagcaaaatctgccatgtcccccattcacatcctctaacaaaggtttgttggccaagtttgggtcatgtgggtagggaaggaagtcagaaagaagagctgatcctcatcttgagccccagttctattaaataattgtatgcatttcatcaagatgctttacatctcgtggtttccaattccatatgaattgcggggtggggatactggactagaagatgagaaattgcttccaggtccaccgtgaattccacaacttcatcctctcccactgtgacctgtctgcactcactagagttcatagtgtacttcataaattgaatgtgctgttgaatcaaggtggggtgtgagagttcatggtactcttctctccactttgaatatgttttaaaagtctcattaaaaaaaaaaccactttgggggtgaggtgggaggatcgcttgaggccaagagtttgagaccagccaaggcaacacagcaagaccccatctttacaaaaaatttaaaaattacccaggtgtggtggtgcttgcctgaggtgtcagttacttaggagactaaggaaggaggatcacttgagcctgggagttcaaggctgcagtgagctattgttgcaacactgcactccagcctgggtggcagatagagatcctgcctcaaaaaaaaaaaaaaaaaaagagaaaaaaaaagccagccaaaggaccagcttagttctgcatggttccttggttcttaatctttagtgaagatcagaatcacctggagggttcgttaaacacagattgctccgctctcctcctggagtgtctgaattagccagcctgcaaggaggcctgagagtctgccttcctaacaagtttccaggtgatgctgatgttgctggtgggagatcccacttgagaaccacgggcacagtggtctatcaggcaggcccgccaccccgaactcatcagcattaccttgctccacatgctcgatgaccctgagggctttccttgctgcccatcctcccatggagacgtggtcctccgtggctgcgctggtggagagggagtcaacagacgagggatggcacagagccttgttctcagaaactgcaagagaccagtgccagttaagaagtgctcctcacaggatgagctgtctaaaggacccgtggcttccacagagtgctccacagcatgggatacactctccagaagatcttggacattatccaagcacctgatggtagaaagctgctttgggaaaaggaagcaggtcattttttttccccaagtgaggactctaaagcaatagtgagttctgaggtaagacggagatgggagaactgggaattctaatataacaaggccaagatgacaacctgggaagcatatagcatgccagggagactaggggagaaagagacatgatggccattttcaggtacttgacgtcaatttggttgtgtcaccagaattccgatgtggcatttggggactgaggctggacccataaatcttgggcaagaagatttaacacttcagagtgttcaaggatgacataaatggatgtaaacaggggctcgatgactgccagaaatatctgggaggtgggggaattctagggaggaccaagacatgggactctcaagctttccagtgcacatgaatcactcagggaccttgttataacaaatatactgagctttgggtggggcgtgaaattctgctgttctaacgagctctcaggtgatggccatattgttggtctgaggactacactataagtagcaaaaacttaggttatgaagttccctcaccctagcttagaagtcaggaaaggtcagactcaaagtctcttctcctctttctctggctttaagagtggtcatgggtgaggcttcagttgttttctatgctgcatgggatcgcatcctaagatgatctcgctttaaactagggtcatgctactttgtcaaggtcatgttggttggccaaggactttccaggtttcagcactgtaagtcccaagtccttggaccctaaactgtggactatacagataagtaaactgtggtaaggcttgttcggaaagataacttacaagggccaaaaaaagaaaaacactaattttactacaatgaaagcaagccaaacaacctcaataggcagcttgggaaactaaaacatattcaaatgaggcttcccaatgtccatcctgttctctagaaatcaatgactactcccccactactacgttattgtgagaaatttctacctgttaaaggggtattttattaataagcaagtaagcaaatagaagataccggtcagaggaggtgaattcagtggctcttagttggttatttgtgttcgttgggaataatattaatagcaactagtatttttttagtgcttatgatgtgccaggctttatatacatcaattcatttaatcctccaaacaacccccttaggtaaactgatctccattttatgcaggtgtaaattgaggatcaacaggataaagaggctcacagagctagtaaatggcagagctgggcttctgatctagcatctacgcatgtaataactcatgctatcctgccttttagggtagggttgttagataaagtaaaggatgcccagttaaattttgattttagattaaaaaaataatttttgtagtacaagtatgtcccaaataattcaaatttaactagtcatcctgtgtttttgttaaatttgacaaccctattttaggattaagtattgattaaaatgagatcctcattaattgaagtaaaagcacatttttgcatgccaaaattcagggtttgaattctgctttacatcttgctagctgtgcaatattgggcaagtcacttaactctcagatcttcagatattcatctatagataacaataatagcacttacctcaggtgacaattgtgcaattaagtgaatgaacataaatgaggcccttagtacttacttagtgccaggcactgttctgatgtgttaatctgtctcttacaatcttgagtcagaaataaactatattgaagctcaatcttcacagagggtatcctgattcttataagcatttttttaatgttgcaataacatctttatgtttttagtggttgttatatctagtgaaatgaatccaaagtttaattataggtttaaaagttcaaagtttaattataggttggttcaagtttcaccattaactataaccatcttagtctttttccaatagtcttcaaatggagatttggaaaaaagctatagagatgaagttcatatgcaatgtcaaattgctttccacagagaaattgtccattacagccttattattgtattattatatttcagcataacagtatcgaagtttttaaactatttttttctgaaaaatattagagttaacctgttacctttgcactgagagaactaggatgcagataaaagtggtgaaaagttagatctcactcacagaccacatttgatacttctaggtgaaatggaaagacccttagatggacgggcgtgtgttctgggaaaggggcagtgtccttaccaagggctgctgccgtgcagtgagctatcatgaacccagagttcagaccaccttcagccaccaggaaggcaggcagctcactgagggagggattgcagagccgctcgattcttctctcactgattgcagcaagttcatggatgccaatggccaagtagtctagggcctgaaagagggtctccatttagtcagcctatattgaaatgtgccttctgggtcaggagcagttttaaaaagcttactttggctgggtattcaccatggaagtttcctccagaaactgtctctcccctattggcaaagaccatctttcaaaagaggttaaggcttgaagataatgtttgctggtcacttcaagtacaaccccttcctgccttcttttttaacgtggaggtggcagtctgtgtacaaatgtggggtggagggaaagagacaagtcttcctgcaagagatataaaggggcacaaaagcaaaaaacaaaaagccttaaaggtggatcatgtacacccaatttggaggctgaaaaaacatgaaccttgaaatgatgttttctcttgagattagattctaaagcaccataactgtactaacctggtggttagtacctgccctcaaaaggtttatagcctgaaactaaaaacagagaccaacacatctgtttgaaagcaacttctgtttcttcaatgggcactgcaaatttgtgttccatagaagaatctgttgaatgggaaactctgctgatgagcaactaccaaaatgtctggaacaatcaattttgagaaaattttcaaattctttactcagtaatctggtgtcagcgttcaacagcagatggtggccaatatgtcctcatgaatccattttaagtaggtggcaagtttaaatttgctgaatattattactctgaggtaattctttttttattttctgtatcattctgtcacccaggctggagtgcaggggcgccatctcggctcactgcgacctctgcctcccgggttcaagtgatttcttgtgcctcagcctcctgagtagctgggattacaggcatgcaccatcacacccagttaaattttgtatttttagtagagacagggttttgccatgttggccaggctggtcttggactcttggcctcaagtgatcagcccaccttggcctcccaaagtgctgggattacaggtgtgagccaccaaacccagcctcagataattctattccatcatgcactttacttaaaccagcaagcacccaggaaaaggcagtaacagatccttcttcctggttctaaagagctaatctttgcctcttgggctcaagaatattcattacctattaactgagaacttgctgtgtgcaagaaagtttctaactttgaaagagttagagatgtatgtgttacattaacctactcaagtgtggattactctgttctgcatgtgtaactgtgagcccattgggtctagctccttggtcttggcctcttctccattctctgaatccctatagcaatggaattctgcatcaatttagaacttagacatgtttttattgtcctctagttgttccaaatttgtttgttggctattagattaaaacaattagaatttaactcccataatatccagcatgtgtgatggggctccgtatctgcaacagaaaattgagacacatattctttcaggtaacagcagtattgcaagagaactcccaaatattagcctattggaaatttatcaataattagcaatctttaattgaaaaaaataaaagacttttggctgaaattcttgctgaggcaattggtagcagaagaatttagtgaggaattaattatcccctgccccatattcagtaattgaatggtaatttctaaaaactatgagataccctttaaaagcaatgatgtaaatgtagaatagatacctcttccctacagtgaaaagactggtacgtgagataagactacatagagttcataaaaactactattccatctgggggatggggtggtattgaggtgaatggagagacccacaatttctgaggcttatttagtgtgggtttgacttcagtgtaaaacaatgtgagagaacataaaacacacattctgaagtaagcttgtcaaaaaacacatacatacaaaagccatctcatgggaaaccttatggagctatcacataaccatcttctaactcagcctgtgacctgcttttggggctgcttactcagcactttctctaggattcagaactgaggcagatgtggaataggaaaaatagattccaaaggcgtttgattatcttcagaggcagtgctatctccatgaaaactgtgccagtgtgactcctgactgatcacctcaacatctggggaactgagccatcatggaacattccagagaaaaaccagatggctctgagataagccacaccattaagagaggacctccatccttgagaaatggaatcagttttactatttctttgaacaaacgcaaaagcactaatttgagcaaagtgcgcatgacaaataaaaactcatgatgggggctgggtgtagtcgctcacacctgtaatcccggcactttgggaggccgaggcaggtggatcacttgaggtcaggagtttgagaccagcctggccaacacagcaaaaccctgtctctactaaaaatacaaatattagccaggcctgctggcacatgcctgtaattccagctactcaggaggctgaggcaggagaatcgcttgaacccgtgaggcagaggttgcagagagccgagatggcaccactgcactccagcctaggagacagagtgagactccgtctaaaaataaacaaaaaaaaaaatgccaaaaacctcaggatgaggaagccataactctttaatcaatactttggtaagtgttaaaaggctgacctctgcataatgcaaactgctctcactcaaagcagagaggcctgcataaattgttcagcatttctgcaatcacatttgtgacccacgtcttcacccttccaccaacaaccttggcagtgggttttagggccagtgtcttcaggaaacatgtcagccaatgctggaaatatcttcttaaatcttgaataggtccattttgaaagtacagcatgttagacttggaacctgagagtaagttcacaggtcacctctgccacttaccagctctgacctggagaaagtcagttaacctctgagcctcaggtactgattcatttactctgtgaaatggagcaatggaactgagaagctacacaaaatgattgtttcagtagatcctaaaattaccagctgcaattctataattgcaggttagtatacaatcaaaagatacaggattatctgttgcgctgttcagttctgtggtaatgatgttcttcacaaatgctattgtatcattcaccacaccatggacctaaaatacaatcaaaataaggtatatgacccatttgattacctgaagagtaccaatattcttaaaagaatatagaagatcttatcttaaagttataaagaatacagaagatcttattttaaagttataaccatggaaattatttgaactgaagataattttgttataattcttttgggttttcactgaaacaaattagaataaattcattatcatatatattcacattagatcaatctatacaaagcagcatggtgtgggaggaagaatgccaactctagacacaggcagattcactcccaggttagtggtaggacttgggcaagttccttaggtttatagttaaaagataggaagacttagaaaagagacaatagcacttatggcttttgagaagtacataaaataatgcaaacaaattcttagatgtgactcgcagagattactcaaatggtagctattatccaaggcggtaaagttcattaagcacgaaggcatcacattagaagatgctcacacataaggcagctacgctgtacaaaccccagaaatagccacaatgctataaagcagcacctggctctggtttctcccagaagtcaaggaagtaattatctgtctgtgtgatcgtgggcaagatacttaattctgtgcctcagtttccccattgcaaaatgggagaaagagtatcttatagttgggaagattaaatgaattaataaatgaaagacagtgataatggtgcctgtcacatagaatctgctatcgttattaaaatatcagggaagtcttacatcaggacttaatcttcctgtagatctaatttggcaattcttacccataggtgttttgatctattgctcaataagctagctagaaaagataacttgctgactaaagggaaatgagggtatttattctagggaggactctctattacaccatagactgaaatttggcacagaccaaaatatggtttattgagatgactggctctctaactgtcatatgtaaattacacatctgtaatacagatgcctaatgccaacccaggtcatctgcatttttaatttaaagttaagcatcacaaattcatttaaaataatttatattgcccataaaatgcaagtaaggtataaccattactatgcacctgagtttcaaaatgatataattaagactttcctgtaaacacctctgactatctggttaaagtttcatcttaacagggagaaacagtacaactctactaactggttatgattttattactaagaatttttaaaagttagggcactgaatcaacataagaggttgtctgggccggggacggtcctcacgcctgtaatcccagcactttgggaggctgaggcaggtggatcatttgaggtcaggggttcgagaccagcttggccaacatggtgagaccccatctctactaaaaatacaaaaattaggcatggtggcacatgcctgtaatcccatctactcgggaggttgaggcaggagaatcacttgaacctgggaggtgaagattgtagtgaacagagatcatgccactgtactccagccagggtgacagagtgagactctgtctccaaatcaaagaggttatttgttggttgtctgtctcaaaaaaaaaaaaaaaaaaaaaaagaggttgtcctctgaaagtaggttgaacaatcaaaagaaaacaaatagttcaccatatagaatagaaactttacaacaattgcacacataaaggtaaaatatacataacttttcatagagacagtaagaaatttggactatagttgaccattacatgtttttctaacactttcctattttaaaatttttcatcctgaacctggggaaagaaaaactttattggcattttttattgacctttttttttttctttattttacctgtggacagcagcgcaaggtgtatgcatcctggacgcgatcacagaacctgtgactctctgtggaagaggtggaggggatgagacagggatcatgttaccaattcttttcacaaaacacgtaaccaaataggtcactcccataaacatggtcagacctgctatttctgatgggtggtgatctgagtccaagagtgaccgaaaccgaaaagcaacttcaatttgcccacggtgaggtcgaagagcatgaatgtctagaattgatgaaggagaaaaagtctgaataattccatttatttattttttttaaagatgggggtctcactacgttccccaggctggtttcaaactcctgggctctagcgatcctcctaccttggcctcccaaagtgctgggattacaggcatgagccaccatgccaggtcgagtaattctgatattagaacaaatgaccatcaatggttcaggaccatctacggtgctgacacagccctcaaaagtcccaggggtccttagccaccactcagaattagaaacttaactccgaaagcacgattttccttattgacttgactccttctactttaaatatctgagagcaaactatatgttgagaccactgggaattccactcaagacactgggcctaccttaaaggaacagggcgaataacaggagggagccctacagtggcctaatttaactcattcacttttagacaatgttctgccctttttcatattatagttgggaggtcgtcaaaattcactactttctaaataagctaccaattcgacagtttttcttccccaattttctagtcgggaccaactctaatcctactcctttttacaggactcctaagtcctgtaaaaagattcctaagacagcacagagcttgacacacccagatccctgggtgctctcaggcaagtcactcaacttccgggctgtgtgtatctgtaaattgcagttctttcaaagatcagttgtgccatagcctagatgaagaggcagcacactgggtacgccacaggcacttgggttttctccttccctactacctgcccccaccacttctgtgtctaaagatctcagccaccccgccccaccacctctggttgaatgaataacaaccaaaaggaagaaccctgctgaccagtgtcaaaggctttggtggtgcccttcagcacctcaagggtcagggctgccacaatgtcagcctgccgtgcaatagcactggctcgctctacagcttcacagcccagggatgtgatcatctgcgtcccattgatgagtgccaggccctgtcgggggagagagcaaagtttcctactgtgattattgtaacgaacctacatacccgtggattttgtatcttttgctttcataagagaaaaattagccagtcataaacataaaaaattatgtttatgttttctaaagtgcgggacagtaatgtttatttaagcccttgaagaataagtgctatcatatgtgaactcgtaagcacaaatctggcaaatgaaacactcattaagtatccacattcccaaagcagcaatgcagctctggagtgtagactgcacataaaatctttagtgcattaggttgcatttcttccttaaattcttactgttatagatgagacatccaaaaaaacccaattctggtccaagactcttagcttagagcattctaaggaatttgggctgagaacatctatctctcagagatcctaacagaactcgatttgaagttttaagttcctaagagaccccctatgcattgtggcatgaagaatctttttttcttttttgagacagggtcttactgtgttgctcaggctggtgtgcagtggtgcgatcatggctccctgcagccttgacctccagggctcaagtgatcctcccaccttagcctccagggtagctgggattacaagtgtgcgccaccatgcctggctaatttttgtcttttttggcggggcggggggggcgggtagagatgggtttcaccatgttgcccaggctggtctcaaactcctgagctcaggcaatccacctgtctcggcttcccaaagtgctaggattacaggcatccgccaccatgcctggcataaagaatcttttaaattcttacggagttgccccttcttcagggatgaactttaagcaaacatgcaagttgcatttaaggaatgattgaggctgagattaaaactgaaaatactgcataaataaaaactcatgcactatgaacatatttttcttgagtttccttacctcttttggttttaaaataactggtttcaatccatgggcttctagcacctatagaatgattaaaaatatgaaaatgggtatcaaatgaaatactagcctatttccaatatcatatggaatccaataatagctctttatgcccaaaagtccatcttataagaaatgagacctacaggaactggctgtattcatgttctctggtctattctctagttctgttctttagtcatgaaagcagacttatctttcaattaatttttgtactgaaatcaggggctccattgtctatagaatcaaccctaaattttggtttctacgtccttcgtgttcagtttctaccttagcagttcaccttttttaccactgcctcctgacatgcaggcatctgacacacatacatgcatctgtgttgtgctcaggctggactcctcccagttcacgctcccttgcctccagagcttgacctaaaaagtcctctaacctcattagtgcttcatttaaatactggcaaaacctcagagcagggtttttgtggcacatgtgtgagcaccaatgaagaggggattataaaattccctctactagatggagacagaatcccgagggggcgatgggcagaacaatcttcccttgaaagaaaagaagtagagagtcattaagttaaggtctctctaggaaagaaggaaggggaagttaaggtaagagaaggacagagctggtcccatttactacgtcaatttcacagattcaagtatcagctagaggctggattctgttctgggtgttggggtcggtctaggagtaggcaaaatgaagacaggcaagctcagggcaatctgagtaatagtacattcagtgcttgaggatgtgggaagtgggtggggtgcagtggaaaacaatcatttgctaggagagcatacaggagggtcacaaggaactcgagaggtaggaagtggagcagcggagacggaagcttcttagagggcttttctatttttctttttattttttagacacctgtctctgtaacccaggctagagcgagcacagtggtgcaatcctagctcactgcagccttgaactcctgggctcaagtgatcctcagcctcctgagtagctgggactacaggcacatgctactgtgccaggataattttttaattattttatgtagaggcggagcctcgctttcttgcccaggctggtcttgaacttctggcttcaaaagatccctagaagatgtttcagaagcagaaataggagagagaagaacgtatttgtaccagaccctctgcccagaacattccttctccaagcaacctccagtttctgcaatgcagaaccacacatagaagggattaggggctaatgtgacaaacaagacccttgaaagccactttaagtttagcctttatcctgaggacaatgggaagcattacaagttttcaccagaacatgcttgaatttgctgtttagaaaggtcagggtgattgctgtatgagggtggtcggaggaaaacgctgtccatagtgaaataatcaaagacaagcctgcacggaagacagatgatctagaagctgcatccccaaaaggattatctatttccttagctgtttcctcttctggggccctctacccctttcacttactatcagggaagctcccagcagttcatcagggatgatacattaaatgatgctttatgctgctgtaatgaaattcagacacagatgaagaaaacaccaaagctttatcaaaaacaggcttttttgattagccactagggtaagagcttagggaaaaatgaaacctgctttccagaagccatatagtaagtgctatgagccataccactgcacctgtgagaccagctcgtaattaaaattgtgagagtgtgtgacctccctgctaggcactggaaatgttgtaggtgcaggataaatagttgggattaacagtagcagttatgccttttcaccaaggtgatgaccaaacccagaaggctgacagccgagtatagaagctaacaacagtcttgcctagtctgacttctaagctttcgctgtctcatctgtaaagtaaggatagtaggagctccctcactgggctgttgtaaggactaggtgatacgaagcatgcaagcacagttggtgtccaacctggggcaattgctgcagatagaagctgctacgagtcttacgtatttagcatcagcccagccactcttcggagaccacatcttcccttctccaactagcccaagagcaagatgagagagtggggcaaggtctccactggcaccaacggttcctttctctgggacatagggcaggcaggaggctgggagagaagtaggcagcaattagttcaagagtactgcattctgactctccttgctttgccagtgagtgcccccactgcccccgcaaacaccctgcctccaatatctatcactttatggcatagatacctggggaaagacaattcttcaaacccagctaatatgtaagggacctggatgaattgttatagaaagaaaaagaggagtgggggtggagaggaagaagagagaaaggtaaagaggagacagggaggaaaggagggctggagggaaagtcagcaagaaggaaagaagggccaggcgcagtggctcaagcctgtaatcccagcactttgggaggccgaggcgggcatatcacttgagcccaggagttcaagaccagcctgggcaacacggtgaaaccctgtctctgcaaaacatacaaaaattagccaagtatggtggtgcatgcctgtagtcccaactactgggaaggctgagatgggagaatcacttgaacccgtgaggtggaggttgcagtgagccgagattgtgccactgcactccagcctgggtgacaaagcaggatcctgtctcctaaataaataagaagaaggaaggaggacacttctggatgcaaagccctcaaaatctgtgtgctctaattcaacctagtacttccacttgtagaaattttagcaatatatcttgaagaagtgatcaggaactagctgtttttttttgtttttgtttttgttttacagttcattgtttattataggaaaaatagttagaaattatctaaatatgaaattaaaggacattcatttgaccaagtttagccattcacagctattggaaaatgtttggaaacattggaaaagtaatataaaatgttccagaaggaggtggtgcaccaaagcattaacaaggtttcccaggggaagagaagtcataggcaactgagtcttttcattttgccagtcacccagtctacactccactgccccttatcaatgaacacgtgccattttctaagaaattcccaaaaagttaccaaaaaagaggcttcatttttctgaaataaaatcagattcctgacagcagcattttttccaactgttaaataatgtcagtcgggtatggcagtgccatccacagaccaacttctggctgatagttcacgctggggaattctcagaggtgccttagactcccccataaagtacaggtgggtttaaggttggagtgctactatctgggattttagggctatatagtatggcagaccaaggtaggagtaaaaataggtgttggaatcactactagtctgttcagcacagccctgtatatacaatagactgctcattgaaattgctctccactcattggcagatcctattcacgtgccacttgcgtccataacatggaaactcaagaatgtgttttgctgtttgtgactgcctcagcactgcttctcctccctctccttcccctcaaagagttctgagtctccactgacctagaaggcttgtccttacctgtgagaagggacaatacctccaatcactgcaaatctggtttccacattagaattttcctatccaagaagaaagctccagagttgagttccctcatatcctgccactacatggcttcttgattacaagggagtcattaacctctttgcatttctgttctacccttgcaagaagttggattttagtgtgcaagtctggccatcacctgggggacattacgatttcagattcccaggcaccaaccagaactactgaattggcctttgggatggacattgatatcatgcaatttttctaaccatattcatgtaccacttaatccaagtttcttctaggcaggcttgaatgtaagggcagacttaagagtcctgttctagtcttgaagatgacaaatgctagggaaagggtcttgcagaataagttaaagttcataggagtaagcatctctgatcgactttctcctcttcccccatctaactatcctactttttgccaacggcatttcccactcatttcaattatttcatgtcttctcaggtgattcctcagcatctggccaatcaattctaccctgtggtacatgtccagcctccacagaggttccgtctagggagccattgcattaccattaaacatttctatgacttgtttgagggtctccagggaaatgccactgtatcctttggctaagacattgatccttaaagccaagagcatccgacacctctcaggacttagtggtttcccaacacctgcaaaacagaattgatgttttctccaagaaaagcaaactcctttttgtctcctgacaattgccctccctccctccaatctttcccatatgtagcccagcctgctattaccttctcctctcggctcaggtagttggactactctccctcctgcctgtctgacttgtctgagccccatcttcctgacaaaggttaagaccccagttttgccttctcaattcccctttttgggaagcttcagtgaacccctgacctcccactcacctttagaatagcatccagagtccttagcacaacttctttaccatctgatgggtgctgattggtgacagtctttcccatctcactatgcccatcctaactcattctttgagttccaggctttatttccttccctgaatgcaacagtgtctccatggcatgggacatgtgttctcataccaaccccatccctccacctggcccatttctttttctgaggctcagctgattctttctgcatcccttctcacctcggcacctagttcttgaaatgctgttttgagaaactagctttttgtgactataactggataactcacactgtgctgtgctttattcatctaatcacacaagatccaggaggcacccaacgttttgacttacctgaagaatgtgagcgtactaagttgacctgaagctccctgcaacagaaaggtaaaaaccctcttagatacattgcagtgagaaaatgttccctcagctgggaaaatgaagggaatcatggtcaaatccttggagggacagaaggaaggcaatgggagaaaccagccagcctgggttttcaataccaactcacatgcaaggtaacccaagcctcatcctctgatctgtaaattggggcaaatgtgaattatttcccttgttgaaaaatatttaaaagatgagggtaggtggaacgtgaacatatgtgtgttttaaacttactgtagcttattgataggaattacagttctggcaaatttcccaaaacctgtagtaataccgtaaacaactagaataaaaagagacattatgcaattaaatgcagggatttttgtttgtttataaaaatatttataacataaagataaaaagatacctgttttctcttttatgatgctatctatgacctccctggatttctgcaccctcttctcagctgttggggtgagctaggaaaatgttgatcagaactgagcacgttaaagacttccacgggcaacaaaaatggccagaggacatctttcccctccctccccatacctttattttgtagcgtccctttcccaagttgaccagatcctccgtggtcagacggtctccatctaactcgatgtactacacaaaagaaggggatctcagtgagtctgaacagcttgattattctaaccagagtagggacacctccaacagaaccaaactgacatttcagagatctgatcattgcgtgaaacatgaatatgctaaataaaaatgcatcttgcataagaggaggcttattggtgcaaaagcataatgcctttccaagccccctttccccactacagagctggataaagccctgtggttggttggtttgtttgttttgaggcagagtctccagcccaggctggagtgcagtggtacaaacatggctcactgcaacctctgcctcctgggttcaagcaattctcgtgcctcaggctcctgagtagctggtattacaggtgcacgccaccatacctggctaatttttgtacttttagtagagatggggtttcaccatgttggccaggctggtttcaaactgatgacctcaagtgaactgcccacctcggccacccaaagtgctgggactacagacatgagtcactgctcccggccagccctgttctaattgacagtgttttctcagaagttttcctggctttcctccctcttaaataaggggccttaattttctgaagaaaaagaaagtggtttgaagcttaccttttcaggctcccggtacttgctgtatctgtatccaggtaaaggaacatatagggtggtgtggaaaaacccccagccccaccatctgcaggagccacccccagagcagaccaaagagcctgtgggaaaggatacagataaactccttctggttgagatggaatgaagtcaggagacatggcatcaccctctataactaaaacaatgcacgggagactcgttacagatcacattgtacagccatgttccccctgttaaaccaaggaacggcccatcattggcccatgaattctatagaaatggctgctttaaaactgcttcagatggtttcatgtggtcttagcatctttatgtaggaggagagcaaaaagcagaaaggtaggtgtcagggcagagaccaggggtttagatgaaagttcaagacagaattccacttccatccccattcccagctttattttcttcaaaatctgaactgatgctatgctgccggcctccagtctgggggtgggggtggattctttcgaaaggcaaaataacctcaaaatgattcagtcactgcaaagggattcagacctgcagccttgagtaccagtctagtctttgttacttactagctgctggagtctgggtaagttacctcctctctgatttctcctccatcagaggtggaggagaatcctacccatctcacagggttgtgtgaggacttaagatccccagaggcgtggcatgtgcctgcacagggccagcctcggcaagcctgacctctgctcatcattttccctgaggtgggggttcaatgctgcaaagactaagccaggccaaaccgcacccgttcgcggccctctcctgcagccactcacccacttccacgaactcgttgttctctagggccacctcgagccggtcctcgttgtccagcaggcccaggcccttgcaccggcgcacaaggaagtgcgcgtcatccacggaggtgaagccaccattgtcgggcttattcttgatatagcgcctcacggcctcccggcccagccagcccacagtgagctgcgcgtcctggcagggcactgccagccattccccacgtacgtgcaccgtgtatctgggcatggctccgctgcagcctgaggtcctcagctggtcacaggaggggagagctttatgcaggagtggctaccggggtgtggtcagctggaaggatgagaatagactttcaaaccactccccctccttcacctttactcattcatgcattggacaaatatttattgaggtacctgctgtccctttggtttttgtagccgagcaggggcaggagcaggggatgcagacgggtgagcctcctgtccactttccatccagacctgctgccagaaaggcctggggtctcccaccctgggaggtgctgttcttgtccctgatggcacctacctgctgctggccccctttcttcagggtccccaatttctctctcttccctcgtttctgtctgtgttctctgccattaagggcagcttataaacaccatgttcctgtctttatctgagattactcaactgtaaaacgtgttctgtgggccaactgtgacactgggagtgtggcaatcgtcactcatttgtttattccacaaacatgtattgagcaactacttcctgtcaccagtaaggttttctgaagctttctttccaccagggaagactgcaaaggccagagatcattttcacaactaaaggtcgtcatctgggcaaatgaaccactctgacttggagattaggggctcagacagccgtggatgagagtccagctctactacttattagccttgattaggtgagtattaccctgtatttccttatcagaaggcctaggggctaactgcctccttccagtatgtgcaggatttacctgtgatcaaatcctggctctgccatttgctaagtgtatgacttgtgggcaagtgatttgacttctctgggcctcagttgcctcatctgtaaaatgaagataatggtaatgatgatagtatatatgtcaaagggctattgggaggatgaagtcagttcatatatgtaaagccctcaacacaacacctggcatagtggaaatattatagaagtgtctgtgattactagtatctggacaccaatactccatgtaactataatgctttataaatgttctgtatgaatcataaagctataaagttccataaatgctctttcatcttggcacatggatatccctcacccaattaagcttcttcaccacagataactgctccctgcacccgccttattaccattggtattaaggaactctggatagcatgattacggcatcaaagatatgcagatgctattttgactaagcagcactttcatcgtaagccaatttttagagatttgattattgcactagaaaaatcctgaaaagtctgtttccactaaatcagacttctgttgggaagagagacatggttgctcaagaaaaacacctatactcatacccagagtccctctcatctgctgacagcttcccaggaagcgtacaaatagctacccttccttgagccttattgaaacttgctcttcagatacccacaccatgactgcaccctggaatttgtcatgacctgaatttgacacacttaagaaatcaccctggaatctgtcacgacctgaatttgacacacttaagaaatctgaaattccaatattccaccttctgaccacaaccttccagctgcccttttactctagtcactgccagccttggacctgacctccagtcagtctcttcatccctccacttcccaccagcatcctcacttactatcctaggaagctggtccctagtcgctcactggaccactctttcttaagcactctgagattcctttgcatccctaaacttatgtctacacttggaataacacccatccccttagtcatcacaaaaaacagccatctcttggaaggattgcttaagcctaggcagtcaatgctgcaatgagttatgattataccactgtactccagcctgggtgagagcaagaccctgtttaaaattaaaagaaactgtcatatctgttcacccaggcagaagacactgatagagaaagtcctgtgatcacatagtttgatggtattgcccttttattccatccagcccacagtgactttccaaaactttgacccctctgccaggaccttctcgacatccacctctaattctcagaaggagaccttacttcctacatctgtgagaaaactgaggactgcacatgtgaaccaccttaaccttctgccccacccccccccattcattccttgactcatttaacaaatattttttcaacacctgttatgtaacaagctctatgcgaggtgctggggatgaaataaataacaaacacgctctacattcatgaggcttactgtctggtgatggataaagctgtataaagatgactaataagaggtctaactatcttcatgctgcaaaacaacccaaactactgcatgctccagttgactgtcactgccgagaccagcttctgagtaatttcagcccaggcatcagactagtgagggaaggagcttccaggtgataccacctcccagccatgtaagtcacccccagcagtttgaggattctaaactcaggccctacgcattgtggagcagagtcttccttgttattctttctccagaaacgcactttccaacttcctttgcctgtctagatctttcttactccttaagcctgtttaggccttttcttctccaggaagcattccctaaattcttcagttgggttaagtggcccttctctgggatgccttagcatagctcttctttagtattatctaggaaattacttgtctgtgttcatccataattatgtatatatccgatctggcacaaagacatttagcatatgcttactagctgaactgaagaaatgtgaactgcaccgagctggcccctaggtaaaccagcaagcaggattaagtttgtctttagcgccctctaccttcttcacagcacccttccatgccacccttcaagcatcccttgtcacaattcactttcagtatcactaagtgataactaaaaacgacattaacttacagcttgtcttgtaagctcatagggcagaagccttaaagagcagtatttgggtaaatggatttgctaaagtctaatcttagaacatgatcttatgccagtgatttgagctgaactcccttctctgtattcttggcaaggaaggcaagggagagcagagcctggagaaagaatcacactgcagcatagataagtgaccaagaggacagaacgaggcgggtggattgcttgagcccaggagttcgagaccagcctgggcaacatggccaaactctttctctacaaaacaaaaattagccagacatggtggtgcatgcctgtagtctcagctactccagaggctgaggtgggaggatggcttgaacccagaggctgatgctgcagtgagctatggtcatgccactgcactccagcctgggcgacagagtgagaccctgtctcaaaacaaaacaaaacaaaaactgctagggagagtgagagccagggaaaagtcaggattccgggaataggcaggaatatgtctcttccatacctgtcccaccttgggtgttcactcctattgtaactttagtcactgcattagcactttgaggggttatttggtcaggacaccgctccccacccccaccccatgccaacaattatactctaagacaccattcctcttacacaatttatttgaccagaggtggacccaacctgggttagagtctcacctctgggaatttggaattgtgatagcctccccatgtggtcagagctatttgtaacagtaaagctggagagtggccggcctgtacaacgtggactagagaggcagaggtgagggacaggagcactgacggtgctgcagtcctgggcatcagaccccttctgtccgtcccaggttctgataatctccccatacctagcatccttaaaataatcttccttttccctttttgacttctggtcacttggattgctgttacttgcaatcaaagaattctaacacagctatggttctaattaattctaactaatagagctaatacactaataattctacctagtacagctatgtgtgctgagatgccctggggcactacgttgcattggcaggggtgctttgttatgtttgtcttttatttggttcaagttattttgttgtctttgaacagactgtgagagggatgggaaagactggtgcttggggtggccatctgacccctgatggacaggagaccaggacaagcccactggatgagccggaggggtccaggaggagggagttgagagctcctgctagggttgacacattctggtaaggagttcatctgctgtccaccaggtaggtggtgtgcaaatacaactaagcattcatgtttaaggtttttttttaattttttatttttcgaggcagagtctccattgcccaggctggagtgcaatggcgccatctcggctcactacaacccctgcctcccagattaaagtgcttatcctccctcagcctcctgagtagctggaattacagtcgtgcctccacgcccagctaatttttgtatttttagtagagacggggtttcaccatgttggccaggctggtctcaaactcctgacctcaggtgattcacccgccttggcctcccaaagtgctgggattacaggcatgaaccactgcgcccggacttatgtttaaggttatttaaaaagcaaagcaaaatcctaaccatgttgaatttttgaatctgcagcagattcaaattaatgaatttaaatcatatatcaggtaaaatactaccttgacatattttgtgatcatactgagagaaaattaatataaagctaattcaaaattttttaatttgtaaatcaaaagattaaaccttgttaaaatttacaaagaatatgccactataagaagaagtagctcaactttatttcagtaaaatcaccaacaaaacaataaaaagccaaaactaaaaagacagttttaattgtgagctgaagttttatatttctttacgaattccatttaaaaaagagaaatctctaaaatcatcaatacgcaggtctttaatccacttttaagtctttccccaccagcattgcagtcacgggatgcatgcttgctttgtgctcttggtaggttcggacagcttgatcatgggatttgtcaaaggcagcaagatccctgccaaaaaagaaaaaattgaaaagaaagaaaggcgagaaggagacagaggaggagaaagggagggagagaagaaagaaaggagggaaggggttcagaggaaaggaaaaaggaaggagaaagagaataagaacacaagtcaatacccaagattaaattaaaggatgtcagcaggggtgacagccagcatcacccaaataaggcaccagtcccagccaatcagatgggtatggtcctgccacagggtcccagagacctccttctgtaccagagactggcctttatactggcagatcagacattttgcagcaagttacagggaagggctagagtggctgggacccgtggctatttaccaagcagcatggaaggattttattatttgaacagagtcctctcatctcctggctaaatatcagccctgtatgtgagagtgagcctcaaagcctttctttttaaaaactgcttttaaaaaaaattttttaatcaagattttaagagtatgaaaacactaaaatttatatagaatttctgaaaacttcaaataattgagaataaaagtcctgaccacagtgaaataataaatacataataaataatacacgaaataaataataaatacactaaataaaaaggacctaccatacaaaaggtaggattagtcatttttaatgtaactactataaacatcataaaacagaaatacttatttttcccacaaaaggtatactcttatttattttattcattttttttttttgagacagagtctcgcactgtcacccgggctggaggagctggagagcaatggcgcaatctcagctcactgcaacctctgcctcccgggttcaagcgattctcctgcctcagcctcccaagtagctaggattacaggtgcctaccaccacacctggctaattttttgtatttttagtacagacagggtttcactatgttagccaggctggtctcaaactcctgacctcgtgatctgcctgccttggcctcccaaagtgctgggattacaggcgtgagccaccgcgcccggcccaagtatactcttatttaaaaacctatttaaagtatactttactcaattcaaagctagatgggttttaattagggaaagcatataaaatatacttaaaacttaattttgtggtcacatcaaaaaagagataatgacttattttgccaagttttatgatattatatggccatcacttttgatggccaaaactgcaattacttttgcacccacctaaatacttgtgaagtaaatgaaaagcaaacaaaagtaatcatggatatttatggcatgatttttttttccagaatttggacaaaattcataaagaccttgactgagatattcttgtatcttgctgtcaagatacaacttatccccctctcactaagcattcctttattatgtcaagcaacctacccttgacctctatgcaacatttgaacacaaaagagttagctttatctgcttatttctccttacatttaacttcagactctctttcttgtctatacctacccaccaattatcttctagttacctttaaaaatctttgtgtatataaggctatctttgatttatttctattttatcagtatctaactctatttgatccaaaatagtaatccatatataatgcttctaaaaagaggaatgaaattatttcacattttaaatatttataagtgtgaatccctattccaaaattatactgataaactttaacaaattaaaaaatattgtcatatagattacgtttaaatatttgacagttttcttcctgtttcttagatgaattcaaagtacggtctgagtgggttcttacttgaataagggccgggtaaacttcattcttccttgttcagttgccatctttagcgccaaaggaattgcgtcctcccacttggattgaatgcagagccgcagccatctaaaaggaggatttggggggagcatggagtagaaaatgaggaaggggcaggatatgacaggtatatcttaatattacttctgtagtgatatgaataaccccactatagttatactgtacaccactttatggtatgtcttgattctgagactctcaaatccttatatatacaatttaataattggtgaagagaaagaagaggagctggttcttgaaaaagatcatatatttttaaaggtctggatcaggtaggtgctcacataccttataaatccaatttctgaaggaattaaactttggtttaagcctcacattacaaatttgaattaagaaagatcaggtaggtgctcacataccttatacatgcaatttctgaaggaattaaactttggtttaagcctcacattacaaatttgaattaagaaagattaacatataatagaataaaatatttctaactattcccatttcaaagtagatttagttggttgtggagaaagcctatttaccacggaatccttcattctaattttttttttttcttttaaggcaagagaggtttagagcaaagtctaacaaaaagattaatactaccagattacatattgcaactattccttaaataccactataagtatttatatagaagcagtcagtttgacaaggaattctcaagactcaagtatgtctcatactctgcattccctttctccatctttcaaaggagtttagttttctgctttcttccacagagacaagttaaaatgatgtacctgaatcgtatttcagaattgttaatggcattgaagttgtacacctcttgcattcgctttatgtgccccaatggaagaggtgcctaagagcaaaataaagaagtataccgtatcatttcaacaggattccttggaagaaaggagctggagagaaatgcatagccagattaaaatcctaaatattttataatatagaaataagtcagataaaaataaaagaaacaaattgcacactaagtaaattctgtgcaaacttattccagatgaggatattctactgggagcacagggataatttactttgtgaagtattcagcattaaatgagaattgctcttcttagactttttagcatgtataaatattatctttcagacttttcctagagtttttctagttattctctataacttatatatcttaaatgcaattccattctccagatgaaatcatagttccttaatttttgcctgattccccctagctttatctttgtatatttcctctgaaatccctgttaaattatctgcatacctacataatagcagttcttaaatgtttgtattatagatctctttgggaatctgatgaataatgtggactctttccctagggggaaaatacacttactacatgaatacaaacttctgtatacaatttcagggggtttataagcatcctatccctaccttaactcaccctaaaagggaggacaagtttgggtgaaggaaagaaaaaagatgagttcagtttggacaagcagagagtttgtagtgcctgtgagaggcagaggtgcctctaggtagatgataactctcccctccaaccacgacctccttaccttacaggactccacactcactaaccaatctctgctttcatgaactactaatcctgtcgctaataatttagtccattagccccttatggacacatgcaactccaagtctaccctggtagaccaactggttaaggtcatctccaaggctccctgacttgccctaagttttgctatacccattccagaatcaccctaccatgttctctctctctgtggccctagaccacccaccagtggtagagcaatttatgaaaccatgatgacccgatgcactaaaaatagattctctctttgatgggtcctttgttgcgtcaaaatcctattcctaatttttgcatcaattccacagaaaattccgctccaaatcttctttcttctcaaggtccttagactgaagacttccctttcatggaagtctttaaaatccagtcattggtttatctcaaaatgcagcaactcctttcggtttcatctattctttcaattgcctagattcgaaaccttaaaatctgcttggattctttactgtcaacccctatagccagtcagtcacagagctctgtgctttcaccctgtgtaaactctttctcacgtcctgttctctcctctccccgcaacttactccctcaagtccggtactcctgccagtctcccaactagtaacttcaccaccatgcaaccttcatggccccagattagttttctacaacccagcatttcatcccgactcttctgctggatttttaaaatcttttcctactgatcagtgtaagatctaaaatttcttagcttagcattgagagtcatcacatctggtcctaccagcttttctagtgttaccttcactgacttccttacccagtgctactgtttactccagcaatgctgcagacgaattccagcccttgctgctccctccaccttcaatttctacctccctgctagccctgggggtgcaaagcaagtctcctccaaaattccctctctgatgcccccagttggaagagtctttcactaattaagtttttccaaatgatacctaaagtatgcctccttttattgctaatgtttttaaaaaaatttttttatgagatggagtttcactctgttgctcaggctggagtacaggggtgtgatctcggctcactgcaacctccgcctcccagtccaagtgattctcctgcctcagcctcctgagtagctgggattacaggcacctgccaccatgcccggctaatttttatatttttagtagagacgagatttcatcatgttggccaggctggtctcgaactcctgacttcaagtgatctgcttgcctcggcctcccaaagtgctgggattacagatgtgagccaccgtgcctggcttattgctaaattttgcatgtgttccccttcctactagattatacgctatttgaagataaggtatatcctttcttacatattttcatatttagcacaatataaaacacagtaagcattcaatgcttttttaaagaaatgaataaattttataaatgattttttccccattagtttccacattaataatcttttgccaagttgggtagaacataaatgctgtgcctttctgtccattttaatttctaagattttgagctagtacttaccctctggagcgtctgtgctaaaaactcattcaattgatgagaagagagatccttcaggtctgtggcattgaatgaatttaaatcatcttctttggcctgaaataaatgttacctagttatttttgttcaagtacaatttaataatacttattggtttatctgacataaaagtaaaaattgagaaaaagaaccatatgaatgaacaagattattcaaaataaatttaagcctgagttacttaaataatcctgagattgagttactgtaatttaaatagctgatatgactcctagaatctatattacttaagaaaaagtagattatgggtaggaagagtggaagaaactgttgacattcattgtaccattcgaggtatagaaatttccaaagcaaagaaacatttcaaaatgtatgcatgtcaactaatctatagaccaattcaaaaaggtaaagaatgaaatcgtatatttttaaatattacattaataaattggtaaggccataaactaatgttttcctccatccccacatattctgttttccccacttaatcttagaaaccatctaagaaaaataaaaatgagtctgcacttttcaaatttggatttactctcaaaaatctttgagaagatgattaagcaatattaaataaagcttataaaaataaggatttttaaatcttttagaactacttttataatcttttaaactagggcttttgttactttaaaagaaatatatgcaaatactaaaaaatcaaataggacagaaggaaaaattcttttggatctgctccctgtctccaagtactactcctcagtaactaatattagtagtttctgtatatccttccactaaatttaatgcataggtatatacccttttaaataaatattttgcatcttccccctcttcagaactctctttaatagcaatacttcttttccctttacaacttatccttaatatgagaacttacagctccagctcattttctgtgcaaaaacctgcaaatctaaactatatattaattaaggatatatttatgtggtaaaaacataaaaagcaagagaatgataaaccaaaattcaggacaatggtaacctggatgggtcagcaaggagggtggagaggggcataagatggggagggatgctacagaggtaccgctaagattttacttcttatgctagtggtgggtcacacaattgttttatacaccatatgaatatgttataaatattcttttgcatttatttactatttaagacaaatcattgagaaataaaatacataaggaaaagagtgcattagtgaatacagtgtcctgaatctgttcctaacaatgcctgtttctactaatattgaagagttgatcattatccaccttaactgctgggcccaaaggaatatttgagcagaaattagtagcagttttaactagcaccaaataagctggaatacatttttcaaactaaaacagagaattttaatacactcacactgttaaaaaatcctgtttcccatagaaatctcttatacttttcttcatgacaagtttgtcaactacacaaaacaggttttaaaaggcaatagctgaactgattgcacagctggaggccattatcctaagtgaattaacacaggaacagaaaaccaaatacagcatgttctcacaagtgagagctaaacgactgtatattcatggacataaaagtggcaacaatagatactgggcactactaggagtggggcaagggttgaaaaactactgggtactgtgctcagtacctgggtgatgggatcaatcataccccaaaccttagcatcacacaatatgcacgtgtaacaaacctgcacatgtgtcccctgaacttaaaagttgaaattacgtaaaaaaatgataaatctgttgcaaattaataggaataaaagtattcctaaatcttctgttatttttcattaaagaattatcaagggctcatccttactttggcttcagtaaagggttctattttagtacatatatgaagaagctcctctttaagaagcttcatagaaagtgaacaaagagcaaaagtgcttcgattctttgcaccactaatagtcagcagctggtcacccaagatcattttagatttacctggtatgtgaaattgccatattggaagcagtatcttataaatgatttaaaaggaaaagaagaaaggtaagatgcaaatatttttgcatactttttttttttaagagttaagaagcaagaaaaatcaggattaatgccttcaacatcaatttttccccccataaaacttaattttctaggctgggcacagtggctcatgcctgatgcctgtaattccagcactttgggaggctaaggtgggaggatcactggagaccaggagtttgagaccagcctgtacaacacagaccctgtttgtataaaaagttttaaattagccaggcatggaggcacatgcctgtagtcccagttactcgggaggctgaggtgggacaactgactgagcccaggaggttgaggctgcaatgagccatgatcacgccactgtagtccagcctgggcaacagagcaagaccctgtctcaaacccttaattttctatattgagagtagatataatatcaccttagataaacctgactttcaaatagcctttccaaatataactgtttgtgatttaaagtaccctccctgcttcatgagtaaagacatatttgcacaattcaaaaaggaatcaaaaatcacacattattacttacagtaatccatctttgacttaaggcaatacaagcatttgtcagagtcatatcataactgcaaagataaagattacattgtttaaaaatgcacgtgcttttgcagaaatgcagttttaaagctacagtacatacttaaatttcaaagtcccttttaaataaggaaaacaaactccaaagtgaggaaaataggaaatattttacctaacttacatactactggcatcatccaagaactcacaaacccaaatggataccacattaatgaaacacccatctatcttttagaaagaatgccaaagcacctcagcaaaagactgtcatgtgctcgagtagtatatgctaaagtagttggaatcagttgagcatatttagtacatggcaggaacagttctaggcactcaagacaacaagatgaacaacatcaagtccttgctgtcatggattttacttggttgttccaaacatctaatcatctaacaaacctgcaagcacctgctacataattggcaccgttctagatgctagacccttgagagagcccgataccattgcctgatgatttcattcctttttagaagaaaatgaaattaacacatggtaattgttaagcaaattataccaatatttgtgtgttctcaacttagaaatcatattttgcaacaatgggaaagaacatgtagtgtgtgcaaaattcttgcaaaacatccctctttctccgtaaatcatgcttgcttgtactgaaatgcttgtattagggaacagagaggcacctgccccttagagcctaaatgaagtaagttttgattagaagttaccactgaatctcccttaaagagagttgtgactgggactccgtttgttccctaggggagacaataaaaaggtcaacacagctcccacctcgaagcagctgccagtttattacatgaagtgtcaggctgtggactgcaggcatgccattttgtcttcaagaacaggtgggatcagaggtccttgactgatcagaatacactgctttcaaccaaaacattattagcattgatttcttaaaaaataatagcaaagtagaaaacctttagctggtctgtttcttcgtgtcctgaaacttccttattagtgtaattaaaagtactaagttaagaattagcctgggaaaggaccctacttatggcaaagtcttcagaaaagtaaagagcaaaaccagatatgtgccttgttctcatggtgctgacagtatagcgaagaggaaatactttaatcatacgaataaataaatgtaaagttagaactgtgcaactgctacgaagagaggatatagcactaaaaagccctagaatgggagatttgacctggccagggatgtcaagaaatgcttccaagaggaagtggttcttgagctgagattggaattaactgggcaaagggctccgggtagagaaaacagcatgctcaggtactatgttggaggacatatggggagttcgagaaactccaaaactgccagtgtgactgaagcaaagggagctagagtgttaggagcttataatccccactaaaggattttgtcttagcccaagagcaaagagataccagtggagactgctaagcaggaggacaacatgacacatttgtgcttttaaaggtttactctagctttagtgtggagagtggctgggagaagtcagaacagatacaagtgcacagtttgggtgccagaacagtcttccaggatgtgaagatgtgatactgaacttggacagtggtagtagaaatggagagatgtggatagactcagatatttaaatacatatacaaatgatgagagcattataaaaagaggatcgtggaagccaagattctgtgctgcaatggatcaaagtattttctgtggtttgagattttctaagatactctctctttacagaattcccgggcacacgaatgattccagggttcctccagcactttggtattacttgaaagcaatcttaagggatctagaatgaaccaacgcccaaaaaggatcccttagcagcggtgatatcaaagaaacacttttgaagaactaattttccacccagatttccccaattttaaaagcaatgggcaaagccttctccactcctaaacttcctggaactgtcttttggctatatcaggcccctgaagttagagtctttgaaagactccaaactccaaattctatgcttttattctcaggctcctcataattctacagcacaccagactgctgaccactctccgtaccacttttaaattatttcttcccacagctttcttaacaatgaacctttgaaatctttttagttttccatttattttgctacctttcctctgtcctagctctaaaatgaagatcctctaaggttctacagtttacttcttgtattctcctttgtaagtcatctccaagacgatgtccaaatccatcaccattaaaattaatagtttcctcacccacaacacttaatattttaaaaaaaatacttttcattgtattataattacttgatacatacatatttgctctgtgagttccttattcatcatattagtgcctgacaataaatgtgtgctggattgagctgaatctttattacatctctgctcagtcatttttaatttcttcttttctcaccacagccaatcagttgccaatagattctagcccccaaacgtctcttctctcagttactcctttcttttccactgcctttgtatgacttcaggtcctcataatctctagcaaggctgttgtaaaaattaacgagataatgtatggcacttcttaatgaagtgctaggaaaaaaatctaaagtattatttttgctgataccttttttagacgttaaaagggtttactgatgatttgtgccacctgtttccaacacaaaattcgaaacattctatcgtaatcacccctccctacctgagctcctgtttcccaccacagcctatgataaccaggactgcccagttagtggggcgctctgaccacatttgttccatactcagaactcccagtaacttctcaaccaaacacttctcggcctggctgtttaaagtgctttacaaacaaacatgaccaggcctcatcttgtttcttagcttctctcctgctgctccctgaacatcaattaaactggcctgtttagtgtaagagaagctggtaggcaattttggtgatccaaaagaaaggcaacaagagaacatgccatggaacatgccatggtcagtgtcctcacacaactcgtgaaagaccagggttcaggtccgattgaaggagggggttcagtataaaaagcagtatattgaggccgggcacggtggctcacgcctgtaatcccaacactctgggagacaaaggcaggtggattgtttgagctcaggagttcgagaccagcctgggcaatatggtgaaaccctgcctctagcaaaagtacaaaaacagccgggtgtggtagtgcgcatctgtggtcccagctacttgtaaggctgaggtaggaggatcacttgagcctggaaggcagagggtgcagtgagctaagatcacatcactgcacgccaggctgagccacagagtgagaccctgtttctaaaaaaaaagaaggaagaaagcagtatattggaggcaataagactgccagggtttgaatctcaacttttactactcactagctgtgcaacctagggcaagacactttacctagctaaacctaacttacctccttgggaaatggggataataacttataacagtgttgtaattaacataatacttataaaatatttttattgcagaagtttgaaggaagatacaatagcttattgtctaaatccctcaccatccttgtgcagaaaggaggcactcaattacttgaagtgaaaaaccatatttgtaaactgcagaaattattcttttggcctcagggttaaggccaaaacacctaagaactctgctttcatcatttactagtaacagtttcaggaaggcatactattctttcagatattttgaggctctctaggagttaggagaatgagaaggaaagcattagcaggcaagtacttacttgggctttatgggaggcagtccaggagagtagagccaggcattccaatcaacttgattgagaacatcaacctatgaatagtaagaattcacagtttacaatagaatgccctttcctgtcaaaaaaaaatttaaacttgtaagtccttagatatataattttgtctaatctgctatatcaagataatttctaaatcttttttaaaaattaatattttaaattgatagatcataattgtgtatacttatgtgacacaatgcgatgttttgatatatgtactcaatgtggactaagtcaagctaatatatccattacctcatctaactctatcttctaaaatttatattcatcaccatactattgatgacttctctgaaataggaaaattctacaggtagttcatgtggttaagatcacatttaaaatagaaaaaatatgcaatgagaggttgagtcctaaagttctgaaccaatactactattagataatacaagttaacctaatcagtcaataaatagagatatatcgagcatgaaaaatagaaaaggtttttaaatccaaccttatctttaaaataggaatacaggaaatccttccagtcatcagtagttatgctcttataggaaaacttctcaacataagcttttaagaatcctaggaaaatctctaagagtaaaaaagaaaagaaatcaattcatagaaaggtaattatttgacattttgtgtgcgtgtttggcattgtactattaaccacagagaacagagaacattcagagaatagggaaatctacgaggactttcagagtgaaagaatgttcaaaaaaggaggtgggacttaagttgggccttgaagaatatatgtaattcagtggaagggagaagagaaattctaattataggtaaggggataacacatgaagacacagaaaaggaatgcataacccaagttctaaaagcaataaccttcacatgactagaaaggagaaaaataagactggacaggcagaatggatccaggtgacagacagccttccaagtcaatcaaccaaggagaacacctcaatgtccatcagtgggggatgggtacataactcagcatagctttatcatgaactagtatgatggcattaaaaagtatgaaacagatttatatgtactgacacagaagggtgtatgtgaaatatcgagcaaaacaaaacacaaatgcagagccaatatatagcatgacccattttttgtaattaaaataattacatgtatttatttgtctgcttgttaatttacacctagaaaatgatctggagccatttacaccaaactgctaacagtggttacccctggggagtggaaaggggttgatggactctcacttgttactcttataaacttctgtaccatagaaatgttttcagggaatacacactattatcctaatttcaaaaactgatgagattttttaaaaaatgaagcagcataatttaaaccttaggggttattaatggttttaagttgagaggtaactcagaaaacaatacagatttcttcagcagctacatccagaatgaattggaagtattaaatggaacaaaacaatagtttacaattcttcctaattctcacattaccctcaaaaagaaaaaaaaaatcataaaataccaactacttacctggtcctccaagcagttgttcaaggtaaaaaagtaaagcaaagcccttctcatagggaactgaagaataagctacatcagggtctatatctgtcagatcaaccacaagtttggtgaaaggatgtgtctccccaaatgtctttacctgcaagacatgaaataacatggagaaacatatagaaagactgctatcaccacgcaaataagctaataaggaggtattacttcactcagtggtgtaactttaggggaatctaaaacttggagactggaacactaggatatgttggcataaacttctggaagtctattaatagaatgcttacttaagtaatattctctgttgtttcttgctcaataatacaggctttattcttataaaaagactagaaaaatgatttaatgcctggtcagcaaatttggctttcaggagacaacacttaaaaatgacataccaaataagatgcaaacatagtaaacagctatattaatagcaaagacccagtgaggtcccacagctccctatttagaccaggtcatcaaaactaccttacatagaacagtgaacagtgtggatcaacacagtgttataccagcattgacttcactttccacacttgtaaaaatgactttttggttgctacacagtaaagacgcttttataaaaactcagtttttaacacctatacaactttggatgaaggtttttaaaactttgactcctttaccgaattctgtagttctccccatcctcccagagcattaaaatgtctgaacttttcaccaaacaatcgtccgcaaatgtggcgttccaagtacacagtatgtccctcatttaacctgaaaaaaaaatattttaataaaaacacggacacagctgagaagaaaagacatttcaatcaagatattttctttttggcttttctacagaggaaagcagttgtaaggcatgaccactacagtctaagccgactctggctcccaggcagtcaatccagagcaatgggaagcccagcccagcagatggcagcagggaaagttaagccctgcttctgctcttgcatgtccctatgttaaaagtgggagtatatcaggaattaaacttaacacctagactgaacctaacactcctaacgctgtaataagtgttacagaatttttaagaactatccttgttggccgggcatggtggcccacgcctgtaatcctagcactttgggaggccgaggcgggagaattatctgaggtcaggagttcaagaccagcctggccaacatggtgaaaccccgtctctactaaaaatacaaaaatgagctgagcatggtggcgtgcacctgtagtcccagatactcgggaggctaaggcacaagaattgcttgaactgagaggcagagagatcacactactgcacaccagcctgggcgacagagtgagactccatctcaaaaaaaaaaaaaaaaaaaaaatccttgttggctgggcgtggcggcttatgcctataatctcagcactttgggaggccgaggtgggcggatcacttgagctcaggagtttgagaccagtctgggcgacatggtgaaatcccatctctataaaaaatacaaaaattagccaggcatagtggcatgcgcctttagtctcagccactttggaggctgaggagggaggattgcaaccctggagttgcagttagcagagattgcaccactgcactacagcctgggccacagagtgagaccttgtctccaattaaaaaaaaaaaatagctgggcatggtggctcacacctgtaatcctagcactttgggaggccaaggtgggtggattgcctgagctcaggagttcgagaccagcctgggcaacacggtgaaaccccatctctactaaaatacaaaaaattagctgggcgtggtggcgcatgcctgtaatcccagctactcgggaggctgagacagaagaatcacttgaacctgggaggcagagcttgcagtgagctagatcgcaccactgcactctagcctgagtgacagagtgagactccatgtcaaaaaaaaaaaaaatccttgcctacctaagagatgataacaaagaaaaacaagagatacacacaaaacaattcagagtggtaggaggcagggaaaaaaaaatcagcaacatgaaccaataaagaaataataacaaaaatcttaccaaaagtgatcccaagttttgttggtcactagattccctgtccagctatgagatatttcatgtgcaatgacctaaagaaaacagtgtgattaatagtaagactgattatcttaacctaaaataacccattctactgtaaacactccatgttattcaatttttaaaaaatattagctgagatattcagggagttactcagttcagcaaaatctttaatttaaccaaagacatacacacacacacaaatatggcataaagtaattagaaaacaaaaattacttagaaaatattaaatagatatatcactgcattaaaaatatttcataaatatatgaagagatcaaaccataaaatttccttaaatctattacatctaattgttaataatgtgagaagagtccccaaattgtccattataaccatatctttaacataaaaatacaagggatattttaaaatcagttgacgtaatacttcttgaaggtaaggccataatgaaaaagtttaacttacattggagagtgacttgtcgcctgcctacaaaaaaagaaaattaccttagtattttagtaatcgaattacagactatctaaaagactgcctacctaaatacttagcatactggcactggtgatccactgtatttctactacagcacttcaaagaaggtaaaagagaccttaattgaaaaaacaaaaaaaatacagaactaaaaattagcatcattctttcttgccctaattctagggaatttttgcaatacaatgaaagccagtctatttgtgtctaacttccatgaaacatttcttctacttccatttttatatctgctcttatttacccatcactttctttctctcctattacccaaaatatatttaataaaactttagagtgtcctatgtgtcctgtgctgtattttatttattttattgctaatccatcactcattttggttctaagaagaatttaaagtagctcacaggcatattaaacatagcagcgttctatggccctaatcctttcctgtacatggtgtactgattttttttttaattgtacctacacaccaagtgtaattggtatagtctgattgtctggatacataatttatcaatgaattgttgttacacagcacccccatgcccaactccccaaataccgtgaacataatattctccttctccaaatggcctgattattttcctttcaaaaacaagatggaggcctggtggggtggttcatgcctgtaatcccagcactttgggaggccaaggcaggtggatcacgaggtcagaggatcgagactaccctggccaatatagtgaaaccccatctctactaaaattacaaaaattagctgggcatggtggtgtgcacctatagtcccagctactcaagaggctgaggcaggagaatcgcttgaacccgggggcagaggttgcagtgagctgagattgtgccactgcactccaacctgggcaacagagcaagcctgtgtctcaaaaaacaacaaaaaaaaaatgagattgtgataaccacaataaacaataaaattagaaacaaaggttacacgaacaagagaaaagatttttatacatatatacattattaggactctaaggttctttacatatatatacatattattaggactcctaaggttcttaagtttatttttgaaacgtcaatttcaaatgaagaaacatttacacttaccagtagagtaggagttacaaaagtaaggcaaggattctccatgccaccataagggaaggatggtggcaggaccaataggtcatactgtccccatacatacggtcctcccagatcttctgctattttaagcatagattcagtctgaaaaatcaacatatatatgtctgtatgccttaattatcaccattgtacatttcttaaaattgtatattgctttctatgaaggttacaagttaatgatttttatgttaaatgaaaatgataaaaagaatgtagcaactacacatctacataaaagacaatctggttctttccccgtatcacttaaaaccatcacatttcacactcaaaatcttcaatctactgtctatcacaatgattacaaaggataactaaatgaccaacctcagaaaactcataagcagacttttccacctgctctttctcagaccacaccaaagttcttgggccaatttgcctgcaagattaaaaagcttaataaaaaagaaattcatggcaaatgattcatctggttctaaaaagtagttaatgtcttgtagacaaacctttacagtgagagtgcatttaccatgtgcctatgggaaagggatgaggttacatggcgtgagctgcaaacctgctgttgtatatgcagcaatagatatgcagctctctaaggaggtacaggctgggccaaaggaaaaaaaccaagacataaggtgtccccaattagtttattgcctcttgtaagacctcttgagggtctcatttcatccctcaatttcacaactatagaaacccagtcacaactcataagaaactattttttttttttttttttttttttgagacggagtctcgctctgtcacccaggctggagtgcagtggcacgatcttggctcactgcaagctccacctcccaggttcacaccattctcctgcctcagcctccctagtagctgggactacaggtgcccgccaccacgcccagctaattttttcttttttttgtatttttagtagagacagggtttcactgtgttagccaggatggtctcaattccctgacctcatgatccgcctgcctcggccacccaaattgctgggattacaggcgtgagccaccacgcccagcgttttttttttttttttttttaaatatacagggtctcattctgttgcccaggctgagtacagaggggccatcacagctcactgcagcctccacctcctgggctcaagcaatactcccacctcagccttctgagtagctgggactacaggcatacactaccatgcccgattaattttttatttttttgtagagacatgatctcacttatgttgcccggcctggtcttgaactcctgggctcaagcgatcctcccactttggcctcccaaagtgacgggattacaggcatgagccacagagcccagcctgtaagactattctagaacaggaatgggtataaactttgtcatgcacttaaaggttgaatactcttatataagaagaaacaaatagaaaatgaaggaaatcctgtcagatgctataacgtggataaaccttaagggcattatgacaccttgaatgaaataagccagacacaaagagataaaatcatactgtatgattctacttatgtgaggtatctaaagtaatcaaattcataggaacagaaaatagaatgggtgttaccaaggactgggcggtgggggaaagaggagctattgtttaattggtgcagagtttcagttctgcaaaatgaaaaatttctgaagatctgtttcacaacaatgtggatatacttaacactactgaaccgcacacttaaaaacagttaagtgtgcttaaaactaagaatgaacaaaaaattaagaaggaagggcactttatttgtaaaatattgataaaatatcttacatttctgtaatatttgtaggcttccaagttctttaatatattttatctcatttgtttcacataaccaccctatgaggtagaaagtcagacattataatttcaaggataaggaaacagagattgagagtgacttgttcaagcttacatgagaatccagatctctaaaggtaagagcatgctcattttacaatacttgaaaaaataaggggtaactggtcaagatttttaaatgtaaaattaatttgttgcctacattttagatttgaatttttctagagctgtcagcttgatatcttgagaaatatgcaaatgattgaccaattaaccttgagagaagttcaagatgcctaagttttgatctttccacaaacctgaaaatttttccaaaagctcacctgctttctaaagctccaacaactaaagcaatcaggtagcagggtattggaacctaaagagggcaaacaaacgcacaccacgtgcttgcattagtgttcacaaatgttacacagtaagacaattcatatttaaaagtaagtaaattccctttcaaatctcctaatattagtagggataactttgcttttatacttctcaaatagttctcatctttaacatatagcttaaaattgtgatataaaacattgttcaaaacatctatttgccttttattctgctaggaacaaaagcttctcacacatgaaaaacaagatcacacatactattaaaaggtgcattttgagcatttctcaaaaagtaacctacaggaagcgcatttcccatatgtttgcctttttcctcctgacttttaaaaggttttggttttctttttttattcctttatgtttcaaagcactattggcatgttgtagaggcacacagagttacccggcaataagtagatgccaaagttatgggagcttggaaccacagaagctgcagtggaagtcaaattatccattgtgaggtcaattaagaaaacacacacacacacacacacacacacacacacacactcacgcatgcatacacattctgttcactgaaggtcaaagatacatgtctaatgaccaggactgtaactgagtgcttttttggtcttgactcctccatttgtaaacactctcaacagccacttgcccacactgtagtaccagggcaggtgaatgcgtaagaactcaaaagaacaggaagccagcccctgaactggagtgagggaaaatgaaaacaggtatgctccctattctgtctctacagcaaaccctctcttcaatacaacactctgtaagtagaacaaaaccctttaaaagcacaaaagaaaaaaaaatgaagaaaacaaaaaccaaaagctgttctcaaaattctgaaatatttcaaaagtaattttgccctctggatgtgtacaagctaactgtagtttaccgccaatgaaaacaaaaatctagaccctaggatcttactttttggatgaatttgtatattttcctgcttgggtcttctgggtcaggtgtttctccatcacgaatagcactcataagtgccaccagttctttagggacagacacctaatcaaggagaaaaatcatttctagtcataaataaaagcttctatgtgtcttaaaccatatatgtaaaataaccttttcttcccattcttgactatctaataaacagactatgaacacaaaaagtatatacatatacaaaaagtatatatatacacacacatatatatgaacacaacgtgtatagatgtgtatatatatgcacacatatatatgtgtatatatataaaacacatatacaaaaagtatatatatacacatatacatatcagttttgtaaataaaattagcaatatgggaaactggcttctttaaaagtgaatgtgaaatttctatccattcacccatgcacattaagagcagagttttggtagaaactggattaaaatcccagctctgccacctaataactaactgcacaaacttgggcaaataaatataacccccgagcctcagtttccccatcaagtaagtgtaaaacttcaaaggcttgctgcaaggaataaataatataagtgaagagcccagcaccatccctggcaatggcagccaccatccctgctcccgctacactcacaaaacagattcaaaaggacgttatatactcactgtaggacagaatggttttgaacaattttgttttgaaaacacacacttggagttacaaatagaggaacattttaaaagtagtaactgtgaaaaactaaaatttattgctaaaaactgtcaaataattttctctggaaatccatacggaaaagacccttatgcggcaaaccatatagtcatttaactgtgtatcctagctccatgattctgaaagtttgatttctgatgaatgccagaataaaggactcccccaagtattaatgatcaaacaagaatatattccagtaggggctagactttcatgttcttcttgcatggctcaggacccaaagctgtgactgaggcaggcacagaattagaagttcctgaaccagtgctacaacaattgtagattctaaagcacaaaactattcaggaaataattcggttcagccacctcccttcatttaggtggtgatacgttatatatatgtgccagctgaggttgcgaggtcataaaacttgttcaagtgtcacatcattatttatttatttttttagaaatggggtctcgctatgtcgcccaggctggccttgaacttctgagttcaagtgatcttcccacctcagcctcccaagtagttgggacttcacgcagttattaagtggtggagaagagccagagccctgggattctttgcctccaagtataatatatcactgcactatcctagatgtaatttggttgtgggatgatttgggaagcaagaaggccccataaatatgggttggtcctcattctatttgcttggtctaagtaggtctagcctccgggatagtgattatttagtaattacagtccgccttttccaaaaaggattagcagtacctaccaagggaataagttggaattgcatacagacaagtctggaatatatgcccactaggcttatatggctacagaatgcatttatagaaacttaaatcatgcaaatgtcaatttttaaaagttaagtaaaaattgttcctaagttcttatttctagatccaggattctgaatttcttctttttgtttgtttgtttttttgttttttgggttttttttttgagacggagtctggctctgtcgcccaggctggagtgcagtggtgccatctcagctcactccaagctctgcctcctgggttcatgccattctcctgcctcagcctgccgagtagctgggactacaggtgcccgccaccatgcccggctaattttttgtgttttttttagtacagatggggtttcaccatgttagccaggatggtctcgatctcctgacctcgtgatccacccatctcggcctcccaaagtgctgggattacaggtgtgagccaccacacctagccctgaattcctttttaaaagtcagattggtttccatttcctttttttcacagttaaaatgtttaaaactgcctttaaagtagagattcagaatgagtgccacagcctctttgtttacatatttcaggtagaatttcattaagaaaaataattctagctctaggaattcaattatcatctctgcttatcatttataccatatttactgatatgcatcatttaattgagttaataattcgtaatatttacctctgcagtataggttaatttcacagaaggagtgtcctgacaaggaaggattgctctgcagtggatggcctgaaaaagggagaaacaagaagaaatagctatttatctttcgcataagtcattaagaaatcattaaaaattgcagcattgttcttagacattaaaataaaaacagtcctcatttcttgggattttttttttttttttgagacggagtttcactcttgttgcccaggctggagttcaatggcatgatcttggctcactgcaacctccacctcccgggttcaagcaattctcctgcctcaacctcccgagtagctgggattacaggcatgtaccaccacgcccagctaattttgtattttgagtagagatggggtttctccatgttgatcaggctggtctcgaactcccaacttcaggtgatctgcccacctcggcctcccaaagtgcagggattacaggcgtgagccaccacgcctggccttttgggatcttttaaagtccaaaaatagattcttggacttttaaaaatcagattttccattttaatctatggttaaccctcacatttcagttgaagcatggagaaactcttaagcagtgtttcctactctatggtctgggtgacagtagtgcccagtgagaagcttttagaaacctgagaaaaaagggctctgtagcaaaacagacctgagaagtatggcatactgcaccactgtcttgcagagccactagaatattagccgcctgaaggctctgaacagacctacaataaagaaacctgtttgatttcttacatttatgttaacacaaaacccatttctctctggtttaacacctaatgggatgtcagtattctaatgaacacagcctgagaaatgttgctgtaatcctgacacttcaatcttgcagcaaaccttgtaagtaaaacaaagaagcaaagaagggagaaagaacagtctctttcaataccatctagacatattcattcatatcatatgcaaagtgtttctgtactgccacaccaatcgttattaacattggttccatccagtatgaccacaggccaggtgccgtggctcactcctgcaatcccagcactttgggaggctcagatgagaggattgcttgagctctagaatttgagaccagcctgggcaacatagtgagaccttacctctacacaaaaaaaattagctgggcatggtggtgcacacctgtagtcccagctactcaggaggctgaggtaaaaggatcgcttgagcccaggagttctaggctgcagtgacccaagttcgcaccattgcactacagcctgggcaacacagcaagaccctgtctccaaaaaaaaaaaaaaaagagcacctacaatcttatacccggtctgtttacaaataagtctgtctactgctggtgaacaatgaaatgaaaacccagcctcattgagacagtctactaaactcaaaggaattctgatattaacacccttctctgaagctattacaaatcctaaacatacttcattccaccacaagctttcttaaaacccccaaactccaggtcttttcatttcagttctagaaaattctccaaagatataggctcccaaatgacctctagatggattaagtaggactagcagagccacctggttctctctcccaaaatagatttccaagaccatgcctctatagttccttaatggtttctagttaggtgacatggcaacaccaaaggggtttttaaatgtatttcattggataaggccaaacccaggcaaatatgcatacagaacaaccgtaagcaaattcatcaaacaaaatcatgtctacatgattcctatcacctcaatcatttattaatttagctgaaatctgtttcccatattcccaccattgctgccaataagaaatggaataatatattcaaaattaacattttcatgactcataaatcttgcatttcttgccaactttggttaatagacattctattaagacatactgcctgaaaatcagatatttatgagatacagattgtgcaatttgtacactcttgcgtagaacatttcatctcttctagattattaaactgagggtttcttagattaaaaagatgtttcaagtggccatagaaagtaaacaggtctgattcatatgctaattccttttttaaatggacttgtattgaaatttgaacctaacacacaggaatattgggagggatgaaacatgtaaagaatctagcacaatgcctggaaatagagcaaacgtttaatgaagtcagttcccttaattgtaaattatttgattactatgaaaagtaggtattttttctttcagaagacagtttgaaatgtattatccttgtgacaggttatctctaattgtatggctctttacccttagttttaaaacagaaaacaaaagtagtttaagtcatgcaattttaaaggtacagttaatatattgatataatacatacttttgtaaatgtgtaagaaaaatatggaaaagctacattccaaactcaatggtggttacctctgggcaatggtgtctggaaaaggtttggaaattaaatctttcactttccatttctttactattagcatttttcataaccagtacatattatttattaatttttcctttcattttatgactatttactgagtacctactctctgctaagttctaagtcaggcctagagagtccaatctaggtggacatatttccaaactgaaagaagcttcttatttaaagtaaggcatgagtgtattaatagtgaaagataaaatgaaaatatataattcatcttatatgtttctataagatcaattaatacattttattaggtaaaacctacataatccataaaaccactgttcattttgcttcattcaaccataggtgctgaaattttctgcatcagaaatcattctggaatcctttttacctggcactgactaaagagatatgggtgttccttcccagaagtctgttcaggagtgagccactggagagcagaagattttggagaggtctcaaaagaaatttctataacaatttcttgatttctgtatgaaacacataaatatattagtagagtatgattccatctagtgaaaatttaaactcataatacatacactgaataatataaataacatagtatgcattctcatcactgattggcagtaagctctaggtatgccacatcctcagtgggtaagtctcctctcagttttcctacctaattgccagcctgtgggtccttttacctctcccatgctaactgctagcgaaggcttaatggcaactaacagtggttgactaccccgttgtgtgtcacgtactttgcatctgtgatatcatttaatattttattagagtgaaaaagtaaaagaaatcatttttggggcttcaactaccacagcagcaggtgccacagcatgacacagagcagtgctagtctgcaaactgttaccggcccaggacaagacaagaccagaagttgagagtcagcattgcaaaacttttagagtcatttttgtctgttgaatctaataataaaaaatgtgtgcttgtatttcatctcttcttcctcatatttcatttttattgcattgtacaaaagtatcagtctatgacagattgaagaggatagaaattggtcctttaccccagagagtttgagaagcactgataataaggaaacagcagaggtttagagaccagcagccctgctggtgttcgaatcctgactctatcacttactggtactgtaaacttggggaaattatttgacctccctatgccacagtttccttgtagaatggggtgaataccatctacctcacaagctagacttaagtgtttcccttctcttaaagggaaagagaaggcatgaaaacactggcctctgaacaactggggtagatcacccttgttctaggccaatagttttcaccctctttcccctcaagaggtggcatatactcccagtgtgacaattctggttgccactttcttgaataagttatttctctaaggttccctttcctcatctttaagtgtagattataccagcagggttactgtaaggattagatacaagaatgcatttaaagcacttatcccaagattgctgcactgtaacagttctatctttggcattatcattgtcccattaataaatgcagctggcctctggggcaagggcaaggagggtgcaacttgtaaagctgcccaggttatcttgaaatgccttcttatgatggcatgcccccaccatcactctagatattagtaaaaggatgaatcgtttagaaactaacagttcccaaagtccttgttgtattatatacaaacaacatttttagtatcttaagtatatataattttaactgctgtatcaactttaatctgaacagaagatcaggataagtagtgtaccaatcattacatatttacaaactaaaatttaaaaagaaaaaatatttaaattagttaagaatatgtttccccattatttagctgtaaaagagaaagatcataacattcatacttgctcaaagcgataggaagagagatttccattggcgatcccttgtaactttgtctttctccaagagcatatttgacttcttgtccattgatcactactttttctattgtaaggtcctttgtatccaaaacctaaaattaatatttttaaatagtaagaaaatagtttcatttaccagaaaaaactcatattagatataggctacaacaactagttgcttatggagagtaaaatacagagtgaaattagaagaattgaagagtcaaaagctagtctaggtctcattttttgggactctaagcatcttgaaaatttttgggttctaagatttgcatatatattgttaaataaccctaggacagtcacacaaattttgggctttaagtaaaagtcaaatctaaatcaaaatatgtttgcttctgactcctaaaattttctctattatgaaaaactttatctataacttaagtttctttcactctggctcctcaatacattacacaatatatttcctcctagaactcatgtactttcaaacttcatgttcgttaagcaaatcagcaaactgtatatcactgtggttgtatatctagaaaaagcccaacctggtatggtaactcagaccaaatgattctgcagaggattgggaggccatatctacttgccatggccaattaaggacaactgctttgggcatgaaggagtgacatcaagtgtcagagtattttctatccccaaaatcctgagccctacaaatcatactctttaattatctctcaactaatctcttgtcctagaatcttgaaccttcctatgccacaagactgtttcctaacaacataaacaaaattctacttgatggatctacccactaaatattctagttttcctccttccttccttaaactccaagggagtttttgactgctatgactactacttctacttcttcattaatcatcctccctttccccttcttccatctggcttcttgctattgaaagggcagcccccaccccgatcaacaaagtcttttctgtccaataaccttgacctctgtctactcacagcccttatggactatgtcatctggttaaaaccccttccttcacttctttgcctgtacgcatacatcataaatggttctctatttgtctaatgtttttttcctttcccctcctttattccaattcaaaaatatggatatgtcccaatgttccagccccggtcctttgattttcttgccatatccttcactccctagctcttactcatgcccacatcttcaattagtatctctgtgaagatgcctgccattctagttctacagttgtattccctccccaggacctcagtcgaatcgcctgctcaacatttccatgggacatagcaccacacattgaataggcttctaaaaattccaaaaatgatttttatactccctgaatcagatttctccccagatttcttgattctgttaaaagaactcttccagttacctaaggtttgatcccatttcccaaccccacacagccacttaaaagttgttctttcacaatgtcttcatacttttcctttctttccactactaacccaggtcaggccctggactggcagaactgctttctaccagatctccctacctctggcattatttttttccttttctgaaatctgacctggctacatgtgaggccaagaaccagccatttcccagctgcccctgggtactttcttttgggggtacctcatttgttatccttactctaaattagtagaagatacggtttatatcttatttaaaataatagggttactccttcatattctagtacctctctagtctcttcatagtctagtacctagttctgaatagctattcagaatagctaacttgttttaaaaacttgatttgagtatcttgtgtttataacacatgcttatatagatgaattaactgggtcatttcccagtggaacatattctgttttctatattggctaaactttccaaatctgttcagaatcagaagtgtcatagtgacaactattttttgtgaaacgttttgatatcccctgtgtctgttatagctcttggccctaccctttcctataatacttactgtactgcattataatgatttctttttccattagactaagggttctaaaacagagaatgttacttaggtctgtattcccagggtttagcactctgcctcaaaaacactaggtgtcaattaatgcatgaagcaggtcctagaccaagagaaaacaaaaaatgcaatgtttaagctgtattatctcaagtcctaagtctcaactatcatttgcaaactactttttaaaattccccttcaaatttcagcgatgttatttttaaaaaatagtcaaaaactgtaataagaaagaaaaataaagaaaactggattgttgacaagttggatttagtactttttaagaaacgtgttaagcatcaacagctctactaattataggatataatttatatgtttcacagtatcctctttgaacaataccctccatccccctaaaaagcagttgtacttctcagtagctggtcagttgacatggaataggtatctgattccttttttgcacaggctggtaggaagctccatgtcaaccctgtggcccacttcttttaaagtatagagggctttatgccatgggttttgtttctcctatccctattctctcttcctgcaaattatttaattatttttaatcttatactatatatgttgcttcaagcagtctcagtcctttctagaacaaagcagagtttttttaaaaaaagctttatgcctcattatgatgtctaaatttacattttctacttgctatgtgcagggatatgatgaaaaaaaataggtttatgtgtgaaacacaaagctaaaactaaaaaaccaccttgatttgattcccagttgagacatttacttagtgaaaacaagatggtttgcagtcagaattacctattgttaactgctggcttctgccttggccatggcactaaaacctcttgagccactaaccaaaagaacacctaaacatttctgaaggtttcagtgaaaagaaacaaatgtatgaaagttatcataaatttggaggatcaaacttcagtgtaaataacccaaaacttgaaaagaattttagaaagcttagaatttgtccgattaagtctccttcagcattcctcaacatcacaaactctaagaacggagaggaaaagaagacatgacgtctctcctgattccgcactggcactgggtcttcccatctcacctctgaaatacagctggcactattatcaatgtagcccatgttaagcttaggcactgttttctaattgaaatcatccattaatcaaacttttgaatgtcctctacatgccagacatagactatactaggaagctgagatacaaagagttatgaaacacagtctctacattcaagagtccacaatctagtggaggaaagaaacaagttaactttaaataaatactaattaactaattaataaggataagctcctggtctaaggcttttgtcataaataagcaaacaattataaacatgttattttgtaccataaattgccttccttgtataacatgtaacattattataattccaggctctaatttgctaaacagacatgccaaccagaaatcactattttaaaatcttacttttctctagatttggggaatgtaaaaacaatgagcagatttttagattgggacattcttttcaaaatttaaacatcctgactcttgcttacttatagaacagagataaagtttttattctacaaaagtgatgagaacacatggatacacagtggggaacacacactggggcttactggagggtggagggtaggagaagggaaaggatcaggaaaagtaactaatgggtactaggcttaatacctgggtgacaaaataatctgtacaacaaaccctcatgacacaagtttacctatgtaacaaacctgcacatttgaagtacacctgaacttcaaataataaattttttaagtttttattttacaaaacaaaggtaagtgtgaggtcacattaagcagcaaaaagctataaaaattttcattcttttacttttatcagcatagtttataatttaatttttttaaataaaggtgaagaacaagaactttccagttaactaagagctttgagtgggtttggggcttagtcaaggttttattatatcttaaaccaattggaatatttcttctgaaatatatgttgcagctaaagattcaaggaagaatttgctgttcatatattagaaaaacctctttaaatttcttccactagcgacctcggttttggtttgcaattattcacatctgaacacaagtgtcctgaattgcttaatttttaaatctctagtacttttgaatgtaggacgtataaactcatgttcaaatatggcagtctcacagtgtggtttttctttttttattattatactttaagttctggggtacatgtgcagaacgtgcaggtttgttacataagtatacacatgccatggtggtttgctgcacccatcaacccgtcagctacattaggtatttctcctaatgctatccctcccctaggcccctacccccaacaggccctggtgtgtgatgttcccctccctgtgtccatgtgttctcattgttcaactctcacttatgagtgagaacatgcggtgtttagttttgaaactgcattgaaataggacttcagccctgcccaggcaaagttgctactgcaattaaagatagcatggtacttcaagaagaccaaagtgcgatctgcaaggaaatagatgccttcctgcttataatatcttaattttctttcttatggtacttttgttgattacctatcagtacatagaggaatcgacctatttttcaaatcaatcagtttagcaaaatgttgagggatgaagagtaagaaagtaagtacttattagttcatattaatgaaatcaaaattcagatccttcctacacaagtaggaaaaagaggcctgaaagccaccaattcttatctgcccgatctgatctgattgcttattgatgtgctttagtagatttcaccatgctacactgtgtaaaatacacatgtagcatcctgccctggtgaagaagccgaatttggctgtcttttcatgaccctcttatttttaaaatgatcttctatgaaattcttcaggtgaaaggtaccttcagatgaaaggtataaaccaaatactattgggcaatttgagcaagaacattaaatataggttatgatacagataaaatcattgaataatattccatgaatctacaacctttcttcattccaatggttatagagtttgtagaagtatgtgttttctaagtgaaataactacttggctccttggaaccaactattaaaaaagcgtattgaatcatccttagaaaatttgaacgtcccatccgttcttaaattattagaagaaagttgataagattaaaaagtagaaaggaccctgaagagagagagctgcgcctagagttagcaagcagggactgttagtttcaaagtagggcggaaagaagaggcctgcccggccggggctggaaatcctaagaggcttgagaacgactagcagggagatccagggaactaggagggagacggatgggtggtgccctgcagacctgtggattgaaataagtgttcccgggaggcaaccgtgggatcagggatcgacaggacatgggatctgagacttgggtgagattgttgactgaggaaggtgcccagggggctgggaaaagtctggggcctgaagaagggggttctgggccgcaggccgaagcaatggggaggccatggagtaattagagccaggaactaaaattatgggggctactgcaaagatgacacctaagggctgggtgagttgagaggagtggacgaggcgctggatgtgcccagggacctcggagagaggatccaggcgaggggcggaggagacatacgtataagtgggggctgagggaagggatgcagaggcgtaagcggggttgagaaggggtgctgtgagagatctgggggctgaagtgcacaacatgagttggatggaggctacagaagagcagacggggacgtggggctaggcaggggccgcggcggggtgagccggagatccgggagcccgcaaggactagggtcgaggggcagggagcccgggagaggcgggcactgggcaggcgccccactgtaccaggctgcgcagattgtcctcctgagactggaccgtgagagcagcagtcccggtcagcgtccggcgagtaaagtcgacgctgcagcgcaggtgcaggtgcttggtccggcagacggaagccggagaggccaacgaacaggtatccactatctcgggcatggctctgggggatcacacagcacagcgacctacagcccaacgctcagctaccagactcgtcgatagagaacctgaggaggagggagagaggtaaagaagaggaggagggattcgcggtgcacgccgggaaaggaagtttcttaaagtcagacgagcgttgggggatgggtgaaggaactacaagttccatggtgccgcgcggcaagcgggcgcttggctacctgggagcgtgtgtgttagggatgttgagggggaccaagcgtgctcctggagctgaagaagaggaggggagtaggggcagttagaagggtggccgaagggaaatgatgagaatggagggggagataaaactgaacactaccattttggctctgttcaactttcgtggaagctgtggtggcaaacgtaagaaaatcaggttcattggtgtttgcatatagcgagggcggggcggagcaaaaacgtagaaaaggcctatcagaaggctttctttcgtgcggttcctcgttagtatagtggtgagtatccccgcctgtcacgcgggagaccggggttcgattccccgacggggaggcacagtaattgttttttgtttttagctgtaagtaattcaaggtttaaacagttgttttgtcagtttcagtgtttattatgtatatccccagaacctgcatctctcaaacggagaaagccaacattcccatcttagaaactaatgaatttctataaaagttatgcactggtcgcaatgggagtacagagctgggacatctagctcagctctggggcctttgtggcaggtgaaggaggattgaaggatgccttgcctttagggtggggcctcaaaattaaaactggaaaaattggaagaggctaggtttcgaaggaccttaaataggtggccttttaatcctgggtgcattaatgggggacccactgaagagttttcagcaggcgactgataaagcatggtcagactcatgttataaaatgcggtatcaaaaccattagcaggagatttaggaaactattaaaatggctcaatcagaagatgctgggggcctgacataggtaagtagtaagttaggatagagaggaaggaatgaatagaaggaatacttatataagtggattcacagattgagaggagacgaaggtggcccaggctttcggcttcagtggctggctagtcattaaccagaggtagtagtctatatgaagaggacagtatgttaggctgtacttgcattgctataaatacctgagactgggaagaaaaggggtttaattggtttacagttacgcaggctgtacaggaagcatagctccagtatgcttccaggtaggcctcaggaagcttacaatcatggcagaaggtgaagaaggggcaggcctctacatggcccgagcaagagcaagagattgcggggccggtgccacacacttaaacaatcagatcccacaagacactgtggcgaggacagcaccaggccatgagggctctgcccccgtgacccaaacacctcccaccaggccctacctccaacactggagattataattcaacatgagatttggtagggacatatattcaaactaaatcagacagatttaaggggaagatgctaaattcaattttggacatatgaaatttgagaacctatgggagtggaagtggagatgtccatgagtcacttggatatttaagtccacagctctggggaagtgccaggtagacatgaccacgtcacataacgtggtggatgaaattatgacagtgggtaagctcaacccaagaagagtgtgtaaagagaagggtaatgaaaacaggttggaagctgagagaacaccagaatttattgttttaaaaagggctagaggaagagaaacccatgaaataaaccagaaagagccaaccaacaatgccagatgcagtcccgaggaccaccgaagtaagaagtgaaaattctctagatttggcagtggggtgagaatggggaaggtggtgattttgttgactgtcgtgatttggttgaagatggaagccagagagtagtggattgagcaatgaagagaagagggaggtgaagcataaaccactgtcaagttgcttggccaatgtgagaagggaagataaaggggaagctagagaggaatgcagcattgagaaagctttttttttttttttttttgagacggagtctcgctctgtcgcctaggctggagtgcagtggcgcaatctcggctcacacaagctccgcctcccgggttcacaccgttctcctgcctgagcctccaaggactacaggcgcccgtcaccaagaccgactaattttttgtgtgtgtatttttagcagagacggggtttcaccgtgttagccaggatggtctgcatctcctgacctcgtgatccacccacctcggcctcccaaagtgctgggattacaggcgtgagccaccgcgcccggccgagaaagaatttttttaatgtttgctttttaaggcaagagaaaactttaacatgtttagatatacaggtgaaagggcttctggagaagaggaaagtttctgcagaaggatcgactcagaggcaaaaaggtagagaagaagaaagtaaagatttcagaggtgtgagggatagttgatgggtttagcatgctggtatggttcaattctctatcaaaagtgacgaaatttagctccagcaacaacaacaaaaaactgctatatttctggatatccttgtgttggcccctgcaagccaaaggaaaacaaaataaaaccaaaaaatcccaaactatgaaatctaataccttacacatgcataggtcctaattcatagggtgtaagaatttgtcatcaacatttgcattttcggatttttttggcaaatgtcctgttgcccaggctggatacagtggcatgatcatgggtaactgcacattcaacctcctggactcaagcgattctcgtgcctcagcctccaagtagctgggactacaggcgcccgccaccacgcctggctaatttttatatttttttagagatggggttttgtcatgttgcccaagctggtctcaaacttctgagctcaagggatccacctgccttggccttccaaagtgctgggattacaggtacgagccaccacacagagccgcaaacattttttgaggtcaccaaatctagggtgacaaatacaatagataacatagaattcatttagtcaaataatacacagtcaaatcatcttatttatctagtatggagaaaggatagtttgttttaataagaacgtcattatcatcatcttctattattgattaccaggaacccacagagtttatgccacttgtgtttaaataaaaatatccacacacaaccacaaataaattcctccattaatatattcatcaaaaaataaattacagtaggaattgttttctgagataccactcaccccaaatatagaatgtacaaaatttgcaatttacaagcaattggagtattattgatatccaatggggaattgagaatgcttcaaaaaatgaggctttccactgcatctataaaagaagggtaaggctgggcacagtggcccacaccggtaatcccagcactttgggaagctgaggcaagcagattgcttgagcccaggagtttgagttcagcctgggcaatgtggtgaatccctgtctctacaaataatagtaataataataataaaagaagggtaatatcagggtttagttaccaaaggagacttaaagatgaaaagatgatctatataaaatattatgaaaagaaataatacctatatttatagagccatatgaacaggaagaattccagccctgctattcacctggaaaagttacttaatccctcaatcccctcaggataattgaggcacctgtggcccgtgcagttgttgaaaagatgaaatgagataaagtatgggaactgcttggcactgtgattgaaacagattgggcatttgttacatgttagctaatatgattattgctgttggcttttgtctattttaaccactgtaatgttatttttccttgttgtgttagcaagagcttttaggacaacctgggaagtgagaagcaaccacggtttgtacagcaaaacaagtcacaccaaattaggcctctaaaaaggaatggcaacattagcaaagatatgttttgaaatgcatttacgggaaatttcaattgttgcacaaatgcttcccttaaaagggcaaaaagactttacattgttttctccccttcctttacatatacctttcctttcttgaaatagtcgatgtaatttgcagatatttattagatgcattctactacactgtgctacctagaaaataattggggaaggttctgtcttacctcttggataatttatactctagtacccagctgtactaatgacctaagacaacatggtgttaagaggagactaaggccctagaaaaactatacatgaaattctagagggacaagttctatccctttggagaaagtcaagaataacgtcatgattaacatagcatttgagatgggatttgaaggatgagccgaatattaataggaaaaatggtaggattgagcatggggagtgggaggtgggcagatttttcaggtggacttagcaggaatcaaggcgtggggccagaagtagagatgtgtttgggaaagaacaattctgaaggtacaaagtcctacaagttaatgcagtgccctcacacactcctcaataatctgcctttcttctttcctctccaggttatacatctggcatgatagagatcattagttgtcttctaatacctatatatcttttcatccttagtagtaaaaccttccatgtttagctggacacatggccacccggaagtagacatttcccaaccttctttgcagttaggccataccattaagttctgtccaatggcatgtaagtggaattgtcaattatgactcccaggaagtgtccttaacagtaactttattttctttttaaccttttctctattcttttcctggaatgtagataagatacattgatggctagagctctgactaccatgttgtatcatgatgttggagccatgtgctgagagtggtggagcagcaaggtagaaggagccatgagctggaaatagccaggtctctggggatcatggaaaccccatgtgaactgctctgaatttctcaaagaaataaatttctactttgtttaagacagtgttatcttgggttttctgtccttcacagggaactcaatctttactaagactcctggtctcagttgggtgagtttatcagttttgccccagatacttgcccttatctgttggttttccaccacattatcgtggacagatctttcttccttcttgcttgtgttatctgctagagcattctttctaatgtaatcatctcactcccctgcttaaaatccttcaaggtcttactaacattgccagttgatattatctgccttttttgatttaaggcccattttcaaatactagaatttttggcatacaatccaagggattaaaagatgaacgtaagctttttttttaaagaaagctttggcaaattttttttaaataaccagttattcacagtatattataatattatatttgtatgcttttatgattttttaaatctgaaattatattaaaatgaaagatgagtctcatttcttgtataagttcacttttttgttgttgttgttttggcatttgatgtttgtaagagttgagaaccctaattttctgagaaatgacatggaagactgcagcagtacctctggactccacagttgggtgctcttcgagaccatgttgccatttaaacagaatggtttcctccctttgctctgcctgctgatgtggtctagctagctcctgattaaactctgcctcttgcctcttttttacagaaatgtgtatcctctacatgcatcaaaacatcacactataccccataaatacatacactttttatgtcaattaaaaaaaaaacaaaaaaagaaatgtgtatccccctttacaccaagttaaatcactcagcttattatcttcaaagtagtataaacccccagttgttgttgtttttgaggcaaagtctctctgtgtcgcccaggccggagtgcagtggcacaatctcggctcactgcaagctccgcctcccgggttcacgccattttcctgtctcagcctcctgagtagctgggactacaggcgcccgccaccacgcccagctaattttttgtatttctaatagagatggggtttcaccgtgttagccaggatggtctcaatctcctgacctcgtgatccgcccacctcagcctcccaaagtgctgggattacaggcgtgagccaccgcgcctggccataaacccctagttttaaattaaacgtttctttttgtttttttttctttttttttttttttttgacagggtcttgctttgttacccaggctgaagtgcagtggcacgatctcagatcattgaaacctctgcctcctgggcgcaagtgatcctccacctgagccttctgagtagctgggaccacaggcacaagccactacgccgagctaatttttgtatttttagtttgtttgtttgtttgtttgtagtgacagggttttgccatgttgcccaggctggtctcgagctcctgagctcaagcaatgtgcccatctcagcctcccagaaagtgctggtatggcaggccaggtccactaacgcaggcctccataacaactgtttcagtactgactgagtggttaaattaaatattaaaatccagtacccttatgcaaaggctggaatgtaacaaaagcccaccaagagttttgcctaggcctttcctgaaccttaaagcatgattaaacaagtttattgggagtctgaaggaactccccaaacctccatgatttagcaggagacaagataaggataatcaccccagcacctgcacccatttagattaatttactgacgctccacaggaaggtcttcaagactcagaccttagttatagacggaaagaagttaatcacctacgtctttagatgaatgcacacttacatatagacatatagcttagaaggtatataagctctggaaaactttgtaattttgagttggtctggtgataatttccaggccttctccttagaaaaaaataaaggtccctattcctgtaaccggttacagaaataaaaactcgcttcctccccagttcacctgcatctcattattgggccacgagaaacagcagcctgaccctcactttggtccaagaacactgggattacagacgtgagccaccatgctcagctaaatcaaacttatttctatatattggtccacagcaatgttcatgattgataaatgaccagtcttactgtggccaccaggtctgtcaggatcttgatcctgcttaccattcccatctcatacttcattcttcccccaaagcactctgtccttggactgcaccttcacatcagcctatctcacaactccacttcttcgcttttgtgttatttctccagaaacatgttgctcctctttgctttctccacattctgcctagaaaactccctgacgcaacctgcagtagttggcaaagtgagaacatgtcgggtagacccgggaggtgaattgaaggggtaggcagggactcgacttgaaagaacctcacatgccttgagaaggagcttggaacttacctttaaggctgcaagaagtcgacgagtcttaactgggatatgcatggtcggtacttgtcttttagaaagatttctctgtggcagcatgggagacagattagaggaggtgtagacaggaggagagaaaataaactcccaagcccatgcatcctcttgccctcttcccttgttgctttaaaagacaaacatgcgcctgtagtcccagctactcgggaggctgaggcaggagaatggcgtgaaccccggggggcggagtctgcagtgagctgagatcgagccactgcactccagcctgggcgacagcgagactccgtctcaaaaaaaaaaaaaaaaaaaaaaagacaaacatgtagttcttttccatttagagagttttattggtgattattataggaaaacagactggagagagaataaaagtaggcgctgcagcaattctcaggtgagagatgatggtggcttggacccaggaatcagcagtagaattggtaagaagtgatcaaattcagcataaattttgaaggcagacctactaggatttcttggcagtttagatatggagtatgagggaaagggaggagtcaaagataatgccaagacttttgacctgataaaccaggaaaatgtagtaggattagctgagaaggagagattgtgggagaagcagactggagtgggcgagggtaaattcaggagtccaatcctttttttccccttaattttatttacttatttatttagagacagcggtcttgctatgttgcccaggctggtcatgaactcctggcctcaaaccatcctcctgcctcagcctctcaaagtggtgggattacaggagtgagccactgtgcccaactcaatctttcacatattcaatctgaggtgtctgtgattcgagtggaggtgctgagtaggcagttggacatatgagtatgagtccagaagaaaagctggaactgggctggagatacacatttgggagttcagcatgtggatggcacagggggaagaagagacgctagctatggagactggaaaggaatggcctcgatgaagaaggaaaaccaaggaagtccgtgtcttggatgacaagtgacatctggaaaaataaaggagcagtgtggtcagggagcctgatgaaattctgactatggatgactcactgttttgtgtaaaaagggggaagagaatttattctaaaaatttgttcatatctacataaaatacttctggagggatgctcaagaaactcatggtattgtttgcctgtgtggacagagaaggaaggccaaagaacagaggtgaaaagtagatatttcaactgaataatcttgtaagccttttgaattttaatgtgaatatatttcccagtcaaaaggttatttattgatatgaaaaaaaataaaggtcactggaatcccaaaccacaaacaaaaacagcccttgctgacttcctgtggacttcatagtgtctaccactggccccgcggggctctgcagcttccacttgagtggctcgatacaccctgcgtcagccatgctgaaccaaggtgttcaagctctctgcactctctggcccttccttgagcctgcatgcccttcccactcccactcttcccgcaaccttggcagggctctcctcctccccttcaggactctgccccccaccaccctccagtctgggctagagtctagtagaatctcccttgctaagagaacaaggtgcatgtgacacccttctcttcctcccttcagtgtgtgagcaaatagaagaaatgattttagccacatttttaatgttcaccttacaacatagttgaggcaatcctgaccagtttctccatcttctgtgaaatttcttcttccttgtgcagccatgcgcatgaattctatatttatagtcacatctccagtctgttctgcatgtcaagaaaaggtttgggactgggtgcggcagctcatgcctgtaatcccagcactttgggaggccaaggtgggcagatcaccaggtcaggagatcaggagcatgttggccaacatggtgaaaacccatcgctactaaaaatataaaaattagccgggcgtggtggcgcacacctgtagttccagctatttgggaggctaaggcaggagaatcacttgaacccaggaggcagagattgcagtgagccgagatcgcaccgctgcactacagcctggtgacagagcaaggctccatctcaaaaaaaaaaaaaaaaaaacaaaaacccaaggtttgggcagctgggaaggccaaaatgaaagaagcacgagaaaaagttctgccaattttgtaaaatagcataagtggtctcctcccagatgcctttctggcaccccaccccaccccatggttgaccgcaggcagagtctggaaagccccacagccacccgtgtttcctcccacacagttctgtcttttatttctcggcttgtgtccttgggagggactggcctgaaccaaataggctgtcacgctgtcctgagttggagccagacagtgccaaccatcacatggccttctctcttaggtctcacaaagtgtgtttgaagatcagcagcatctgcacctcctagaagcctcatcagaaatgcagatcttggccgggtggctcatgcctgtaatcctaacactttgggaggctgtggtgggcggatcacttgaggtcaggagttcaagaccagcctgaccaacatggcaaaaccccgtctctactaaaaatacaaaaattagctgggcatcgtggtgtgcatacctgtaatcccagctacttgggaggctgagtctgaggcatggcgtgcacctataatcccagctccttggtaggctgaggcaggaaaattgcttgaacccaggacgtggagtttgcagtgagctgagatcacgccactgcactccagcctgggtaacagagcaagactctgtctcaaaaaaaaaaaaaaaaatgcagatatcaggcctgccctgacctactggatcagaatccacattttattcagatccccaggagatctgtgtgcattttaaatgagatcactgccttagaggctcaagaaatacttttggcattggagaaaattcagtccaagtgttaatcaaacatgtcaggactccttctcttagggtccactgcccttgaccgccatatcagtactctcttaataccctagtgttatcctcaacaaagcatttaccacactgcatcattgtcagtttacttgtcagccttccctactacatggtgggtctttaagaccctgattgtatattctccctctcagcacatgtctgttgtatgaatgaacaaatgtataaatgagcgaatgagatttcacatgaggttccaggcaaacttttattcagtgtttcactctgtgttgactttgcagcaaagaaaaagccaccttctgcacttgcccttgtcctctgatgtcaccaggcaatgtttgtttgtgatacagaatgcccttgccagcccacccccccactaattgtaaacacttttaaaaacattgttattgaagcatactatccattcataaaaatgcacatattgtaagtgtatagctcactgaactttataaactgagcatgccagtgcaatcagcacccagatcagagacagaacattaccaccactgcactgttgcctcccttaagttccgtttcagtctctataaatcctgcttcctaggggtaaccactgcctgacttccaatagcatattaccttgacctgttcggctatttatctttcctttgcataaacagacacatacagtatattctgtcatgcctggctccttggctcaacattccttttgcaagatttctccataatgttgtgtgtacatctaggctgtgcacactcactgctgtacagtgttccatgtgtggatataccatgatttacttatcctttcaaccgtggatagacatgtgggtgatttccagttctgagttattattatgaatggtgctgctatggatattctggtacgtgtctttcggtgaacacattgtagccaggttttgacatgctgctttgaagtttagacagttgcaccctgccaggagatttcctttaagacccctgcaccaggccagaaacattcactgcattgcagcaacctgattctgtagttgttgacacaaatccaacacccttctccctaccccagcttgggtaggggttaaaagtagatgaagtagggagggaagctgttttcaagttacaagaaaaagttctttacaactgctggccttgttcatactttattttcctctcactcacttccgtttcttttccaggtaagcctgattgcaagcttcattgtacctgtttctttctgactcagattccagctcagcttacatttttcccactaagtaggcagtgatatttcatcacagcaggtacttacaccttttgttctgatgacttaaagcacaagtaggttttgataagtgcttgcagggtttcattttcaaaagtcctatttctgtgtcatatttgttggctttgagcccagtttctcttgctctgccaacagagcaggttatgcctatttgctcatggaaataacattttcatgagcaaaggctaaccccaaatgctttcctcctaaacgttcttctcatctacaaatccatgtttgaggaactattattttgtcatttcttacaaaaggtttttatttgaaattcagagttgagtaaacccatggaagagactcacatggttgactcactctctgccctctcctgcacatgtgtctcaggatttcttaaacccagccgagcacttccgcaaacctcccagacctgacctcctcctcccttccaagctgctccccttggcttccaaagcagcccccttctcctttcttcctcacacacacactgcaccccactcagctctatccaaccaatgcacggtcctggaaggccctccatacccacttctctcacctctgctcaactgccccctttcgccatagatatattcccagtgtatttttctctcttttggttattaattcttctgaacatgaacttcacatacctatgtatgtatgtatgtatgtgtatgtatatacacatacatatatacatgcagttaatcctcattattcatggatttggtgtttacaagtttgcctacttgccaaaatttatttgttattccaaaatcaatatttacagagcttttgtggtcactcttggacacactcagagctgtgagaaatttgagtctccggaggcacacagtctcaactgaggttaaacaaagtgaccctctgccttcctgcttctgcgcttatactgtaaacaagtgtcctttttgcagtctaatgtcaccttgtttacacatttttgtgcttttcgttggtgattttgcagtttaaaatattccccaagtgggtgctgaagtgctgtccagggttaagcgcaagaaggctgcgatgtgtttagggacaaagtgtgtgtgttagataagctgcatcaagcatgagttacagtgctgttggctgtgatttcaatgttaatgaatcaactatatattacaaaagtgtcttgaaacagaaaaacatatacaatgagattttgtattgattgatgaaaatgtgaacagaggctctcaggaacctactatatttcccctgggagcaaaggttcaggattcactaatgcaatgtttatgaactttctaagatataattactgcaaatcatgagaatcgactgtatatatttcttgtccttctggttaatttgtatttgtttctttatacctttctcactctgttcccaaagaagtggagaggggcagtttcttccaggtataccttacaattctgtcgtctctattgcagcccccagctcagtacaaacaacatagtaggtcctcaaaagattcaaaaggaataaaagacaggagtggagaaaggaaggaacaaaagaaggaacgatggcagaacgaaaagacgcaccatggaagctgagggtgctgcttatctaagcgggcgtggcttcccagaacttctcatctctcactccttaaatgcttcctctttatttcattgaatcattgaactagaataatataatatcagaaatcaagttatattttatgatagatttggctttttctgctgctctttgcaaaatctaacaaaacaaaccttccagtttctttgatttttttttcaaacttttcttctccctctcctcatcctctactccttgatcttcacttggagaaggacaattctagaattcctgaactctaggccaaaaggaagtgggcaatcatggcaagcataaacacatccatggcaagttatcagacaccttttgtgggtactaaacagcagggatgcccacttgtcccttggaagtttgcaaacatactgggaaaatggggactataaaattaaaccaccaaagatcagtgtgggagactgaataattaaagggtatccaggtggaccagtcacaaacgctgtaggagctcaatggagacatcagtgggcatcttcctggaagcagtgaggcttgcatggaaataaaaaacagggggttctaatttttgttattgttcaccaatatcagcaaaaaaggtgggcacaccctcaataaatgtttgcaaattctttacatgtgctaattaatcatatcttaagatgcaaaatacattgagggcaaggtttactcttaacaatggtcaatgtaaatccttactttaaataagcatcttataattatgatttgcatggggggcacattttgtcagatcttatttgtcatcattattttgttttgtttgttaatacactcatcttatcttggagtaggagaattattaggtctgttaatctttcttgttgctcactgttattttgctatggcagctcaagctgagacagaaattggtaccaggatgggtgctgctataacaaatgtataaaaatagcaaagacgtggaatcaacctaggtgcccatcaatgatggattggaaaagaaaatgtggtacatatacacaatggaatactatacagccataaagaagctgtcctttgcagcaacgtggatgcagctagaggccattatcttgagtgaattaacacagaaacaaaattaaatactgcatgttttcacttataagtgggagggagataaacacagggtacacacaggcataaagatagaaacaatagacacaggggactccaaaaggggaaagggaaggagggaggaaagagagttgaaaaactacctattgggtactatgttcatgttcaccatttgggtgacagttcagcagaagcccaaacctcagcattaggcaatatattcatgtaacaaacctgtacatgtacctcctgaatctcaaattaaaataatactactactaataaagaccaaagtatttcagagggaggaagaatttgcatggtgaaatttgcgtagtgaaattggcatccatatggtgcataagggatatctttggatcttctgaattacattatatacattttttaaattaaaataaattctaaaaatgtggaagcagtaatgatgcagggtgatgggtgaaggctaaaagagttttgagatacatgctacaaaaagccaaggttgctgtgaaaaaattgctaaagatgattctggtgaggactcaaaaagagcttctgtcttccttctttgaggatgcgtaaacaatcgtgaacagaatgctagcagaaatataggtggcaaaggctattctgtgaggcctcagatggaaatgaggaacatgttattggacaatggagaaaatcctttttataaagtggcaaataacttactgaattgtttatgttctagtgttttgtggacggtagaactttcaaacaatgaaattggatagttggctgaggccatttctaagcagagtgctgaaagagcagcttggttcctcttgaccactgatagtaaaatttaagaagagagaaatgaattgaagaagaaattgttaatcaaaaaataaccagcacttaaagatttggaaaattcttagcctgtccttactgcaaaaaaaatgagaaaccatgttcagaagagttaggccaagcatggtggctcctgcctataatcccagcactttgggatgccaaagcaggcagattacttgagctcaggagttcaagaccagcctgggcaacatggtgagaccccatctctattttaaaaaataaaaaaagaaaagaaaagaagagattattaagagtgtggctggtcacccatttgataaggagagtagtgtgagtatcaaccatggacctaatcagccatctcaacagaagccagaaatagagttgggattattccaggagaaataatgctttagtcccctgccagttgggactaaaaggaaaagagaaaacaagatggaatgaagtaaggctgtgaatatgcaatccccttcaggaaaagagaggaaggatcccaaaggcaattcagacatcatcagggctgctactcccaccacaggcccagagtggaaaggcccctgggaacaaggctacctccatcttggtttcaaagagtgggactgctactcagcactcatgtgggtgtggccctcacagacagccatgtgggcagtgctacactgagctgaagaagcagggacaccccactgaaagatgggggtgataccttccagtggttctggaagggaggaccaccaccccagtgggcctacagggcagagcattctttgagccaaagaggattgtatttcagttttaaagcctaatgaagtttgacttctagattttggatttcttggtacttgtcacccctttctacctttcaatttctcccttttggaataggaatatctatcctgagcctgttccatcattgtatttcggaagcacataacttgtctggtttcacagattcacagttggaaaggaattttgccttagggtgaattttgagtctcactcatattggatttacatgatatttagatgagactttaaactttagagttgatgctggaatgagttgacttttgagactgttaagatggaatgaatgtattttaaatgcaaggaggatgtgaattttgagagggacaaagggcagaatattatgaactaaacgtttaagtctcccccaaattcatatattgaagccctaacccccaatgtgagggtattacgaggtgaggtctttgggaggtaattaggtttggatgaggtcatgagggtagatcccttgtgatggaatcagtgcccttataagaagaagagagactagagcttcctctctctgccatgtgaagatacagcaagaaggtggccatctgcaagccaggaaaaggggccatggcaaacactgaatctgctcacagtctgaacttgaacttgtcagcctccagaattgtaagaaatgaatatctgttgtttaagccacccagtctataatattttgttttggcagccttagctgacccaggcactcacttatgcttacattctaacttctaaattaaggctgcaatatatgaaacatgatcatagaacttgtaattatctgaggatccagaaaaatcacgagcctgcacaaggtttatccagaggcagaggaaataccagttcactgagaaaaattaaagggacagtagaagaataaaatatagttgtttataattgtatgttacaaattatgtttgtgaagccagttacataaataatcttaaagatttaatagtttctgcctgcatccaaataattgccatgtgcctatgtccatacgcctatgtccatactactttggaaacctctaatgaatgaatgtgtaaagtttggatgggtatttgagagggaaaatacttcttatgaggttgacagttataagcaaagttaggaacaaaaagcaaattcagaaaaaaactcatcttttgttatggtctaaatgtttgtgtcacccccaaaatttatatgttgaaatcctaacccccaagttgatggtattggcagatggggcctttggtgaatggaatttgtgctcttacaaaagggacttcagagagcttgtatgcccttccaccatgtgaagacacaggaagaaggcaccatctatgaaccagaaaatgggccctcaccagacatcacatctgctggcatctttatcaaggacttctcagcctccaaaattgtgagaaataaatttctgttgtgcataagctacccagtctatggtattttgttatagcagcctgaatggactaagacacacttattgaacccccacgtgtttttctgaagaatgaatgcctcacattttacacaagatgtctgtgtgcactggggccgtctagtctaccctggcctggtgatcagggcagggaatcactgaagtttcccattctctaaaagtggaggaaatggcagccatggggaagctgccttctgctaacacaattgagccgtgaaaacaatatacaactatttttgttatattccagtggtcacacagagcaaccccaatacaataggagggcacaccacaaagccatgagtaccaggaggggtgatcactgggagactccttggaagctggctgccactgtgaggcattatctctgtttcacagaggagaaacagaagctccaataaataattgctcaagtcaactcaacttggaacaggcaggtctggggttcaaacccagacaatgagaccccagaacacatccttttagaacactgccctataccctggcctcaccacaggcctttttttctaacttcctctcttcccctcaccgcgcaaaacattgcaaatgagatttttcctttttcttagaccatttcaaaagtcattgttacttaagggtggaggttggaagatttccaaagaataaaatatacagagaatatctaaccaaagttcctaacacatacacaattcagaaaatgtaactcacagacaagggataacaagaccattgacccaatttcagagcttgacgtttacaaaatgaacacaaggcagtgtgggttgtatgcgcgttctgttcagtttctctcctttggggttgtttgggtcagcctgttgtctcatgagactgggtgggctaaattgagcaacattttgctataataagtctgcaagattagaccttaggcaacaaaagccggaaggagaaactacatttcctataaaatgtggaactgtgggataacagtgtaacaacactatgactacaaacagggaaatttatatatgagaaggaactggattgtatgttacctatataaatgatcatgagaaagtcatgttgttcttttgttgtgatcttttaaaccaaatttatagtgcattgaaccaagtaattgtaggccattattttaaagtaggttgtagcacagcatgaattaataatcacaccaattttattttacttcattggatttatttagcaattgtttttagcacttcctatatcccaggccctcttctacgcactttaaatgtattaacacatttcaattaatcctggcaacagcctgagaggtaggtactattactattcccattttacagatggtgaactgaagcatggtgcaattaagtaagcagccaagattcaaccggaattcaaaccaagcaatcaggctccacaacctgcctttttaatctggctctctgccttgtgcaaaaagatggtgagttagtccgttctcgcactgctataaagaaatatctgctgggcgcggtggctcacgcctgtaatcccaacactttgggaggccgaggcgggtggatcatgaggtcaggaattcaaggccagcctggccaagatggtgaaacccgtctctactaaaaatacaaaaattagccaggtgtagtggcaggcatctgtaatcctacctacttgggaggctgaggcagagaattgcttgaacccgggaggcagaggtggcagtgagccgagattgcgccactgcactccagcctgggtgacagagcaagactccatctcaaaaaaaaaaaaaaagaagaagaagccaggcacggtgactcatacctgtaatcccaggactttgggaggccgaggcgtgtggatcacgaggtcaggagttcaagaccagcctggcttatggtgaaaccccatctctactaaaaatacaaaaattagctgggtgtggtggcaggcgcctgtaatcccagctactcgggaggctgaggcagaagaatcacttgaacccaggaggcggaggttgcagtgagccgagatcgcaccactgtactccagtctgggtgacagagcaagactctatctcaaaaaaaaaaaaaaaaaaaaaaaaaaccctgagagtgggtaatttacaaagaaaggagattggccaggcgcggtggctcatgcctgtaattccagcactttgggaggccgaggcgggtggatcacgaggtcaggagatggagaccatcctggctaaaatggtgaaaccccgtctctactaaaaaaaaatacaaaaaattacccgggtgtggtggcggttgcgtgtagtcccagctactccggaggctgaggcaggaaaatggcatgaacccgggaggcggagcttgcagtgagccaagattgcaccactgcagtccggcctgggcgaaagagcggaaatccgtctcaaaaaaaaaaaaaagaaagaaaagaaaagaaaagaaaggaggtttaattggctcatggttctgcaggcttcacaggaatcctggtggcttctgcttctggggaggcctcaggaagcttccaatcacggcggaaggcaaagggggtgcgaggtgtctcacatagtgggagcaagagcaagagagagctagagaggaggtgatgtacacttttaaaaaacctaatctcacaagcactcactcactatcacgggaacagcaccaaaggaacagcaccaaggcgatgatgcgaaaccattcatgagaaatccgcccccatgatccaatcacctccccgccaggccccacctccaacactggggactacaattccacatggatttgatgggaacacacacccaagccatgtctgatggacacatagtttattttcttttgtgactctgcataggccattcttgccactgggaccccttccctcccaatcctcctggctttccctgcctgtcagcaaactcctgctcctttttcaagcatcaactcggatttaccctctgctgtgatgtcttctgtgactcacatgcagatttaggcacctgtttattgtgttctcaatatatcttacccatactatagaaatatttgttgttttttatctacctagtgttaaattaaataagcacgaggccattggccagaggccctctccatattttgagtttctgtggaacaaacagcaacctaatagtatgtaaacaaactgaaacctaatttaggagtatatttttgtaacatatagcctggtttcagccaatcacagagaagcttcagccaataataagcatccaattgatgagaccacgcccaataaggcagatgcctagctgttgccgatcaagtggtttctctacattgcttttgtgttcaccctagaaaagctcattgctcacactgccaagtggagttttctgaacctcttctggttctgagtgctgcctgattcatgaatcattctttgcccaaataaactctgttaaatttaatttgtctaaactgtttcttttaacactagcttctattccgccttctctgacaagcgttcaggaacccaccccacccccaccccgtactttgggtgtagcccatgtgatttaagtctagccaatcagagcactaaggagctacagttcagaggtgatcatgagacccaggttcatcgaactagagtgaatcctgggactgagcatgagcggctgggaagaaacacacaagtttttgttgcaagtctggagctgctagcagacttcacatactgcctgagcatgaagcaaaaataaagagagtgaaaagaatgagagagaatgggaaagagtctgctggtgacattatttgatcctctgaatgatgcctcacttaaattcaagatatattcttggattttgtgcattaacaaattccctttttgagcttaagcctgcttgatttatctatcatttgcaaccaaaggaacattaaccaataaatacatttcactgtatatctgtgtctatatatctatatgtatttcattttaccaaggtgtctccctactaaccataattctttgagggcagtagatgctcaatatttgtcaaatgaattcagctgaagggtgttttgaaggagactgaccttagaggagggacattttaggaaggctaatggacttagtgtgagatgtgatcaagggactcaaccaagttgaagagtaggattgaaagggaagggacaaataccaaagaaagatttaacaaggcagtgatacagagtggggtggagcaatagttagattaaagcctgagtgctaccctgttctgcgtatttgtttcttttggtgtctctttagcagccagcctaaattaaaagtttattgtactggctgattattgcctgtctaaatcacccgtctctgttagtttatcacaagtgaaaaaattaatgatagagaatcagagactcacatataagcaaataagcatgattattataagaaagagcttttattaaacaatactttcaggtcttcataagaataggggtagaatttcagagacccacataactcagtgtgcagtaaatgctgctcctgggcaacttaatggagcataaactgccagcaacggtcccaattgaaatggagactggaaggtgaagttgtccttcctttctgtaaccaccaggcaagaggacacttgtaaggtgtgagtagcagcacccaaaaaccagctgcaggactcagtggaagggaggaataaggtcactcttaaaatcctatcacctcacatagaaaaatagctaagtcctaattaagctcaacatcgccactctcagcttatccctgagacaggtcaggagaagagggaccatttgctttgctctgggattgttgcacttctgcaatctgactttgtaaaaaaaaaaaaaattaatttaaacagttgctaccatatgggatagtgtagctcgatggtttctttctctctctcgtccctctcctgctctgccttctatgtatttaccacccctcttgcagaaatgctctcgtggaatgtggcttttttttttttttttttgagatggactctcactcttgtcactcaggctggagtgcagtggcactatctcggctcactgcaacctccgtctcccgggttcaagcgattctcctgtctcagcctctcaagtaactgggattacaggtgcccaccaccatgcccagctaatttttatatttttagtagagacagggtctcaccatgttggccaggctggtctcgaactcctgacctcacgtgatccacccacctcggccgcttaaagtgctgggattatggatgcgagccaccgtgctcagccggctttccattttttttttttttaagagatgggggtcttactctgttacccaagcagtggcttgatcatagctccctgtagccttgaactcctgggctcaagcaatcctcccacctcagcctccagaatagctgggattacatgtgtaagccactgcactcggctaattctttagtgttttgtagagatgagggtcttgctctgttttggtcttgaattcctagggtctccctatgttgcccaggttggtctcaaatccctgggctcaagtgatcctaccacttcagcctcccaaagtgctgggattacaggtgtaaaccactgtactggccaacttcctgtgttttaaaaatcctcccagttggggccagtgccctaacctaatggatgcacaatgagccagttgaatgtggcctcttttagtcaaaaggaaagattctttttttttttccaagtatttctttatttatattactaggcttaagttacatgaagaaagacaactaagcagttctgcccatttcagaaaaagtttccaatcatcaccaattatgtgacaacaaataactaggaatggtgacagctttgggtcaagaccaacaaggaagaatgggctctggtgctacagttcatttccaacaagaatatggcacaccagccagcacagccatgctaacactgggccttcagtgccaagcacagattcagatctattctctgaagttagcaaatcaagtgaaataactggaattttttttaagtttaaaatgaagcccaagtaagtttaaaaccatactcttgtcatattttcctttcaaaattcacataaaacacacttttcatgccaatagcccagatattttttcttacataacccactatgtagctgcagacagactcttctacctcaagatgtaaacacaggggaaaaaattaatggccatctgtctaatattctctctatacactgctgttggatggaaaatacaaaattttgttttaaaggttccatcttagattctcgcaacctgcaggtcatacatctgactctgatgctaaggtgacagtgaatgtcacctgatgtttgttttcagtaagggggatctgggaaggatgaatttatctctttttcttcaagaattatcagatgatacatgctcctcagagccttcactctcttgaacttcagcactttccaggatcacacagccttccttataacatggctatctccagtggcaaattcataaatccaccccggtttgctattgcaacttttgcagctcacatcttgaaccctgtggctgccagtgagcatgaccagatcttaaagttcactgcacagcaggttaacgaccttgttaaaaggccagggcgcctgtgaactgagtggagatgagttctgggcggttggtcaggatcatgtcagtttgcacaggaacacagacaggtaccaccgatatgatcaaggaaaattctgcccatttttatagctgaagttctaaaatctctgagtggcgatgagatccatggctgccagatctcctcgcctgggatgaaggccccaggattcttgacagttaattaaaaccagaattcatactgaagcaggaaattttccctgacccctcacaggagggggagtgcaggtgagtgggtgcaggaattggggcgagtgctttggggcgctggcaggagcaaaactccatgaggccctgcagcacggtctagtggggtacccatgactcctgaagccccagaaagagtgttacagtgctcttttagcgttgccatctgtggacagcttaagtgttaataactcagtggaaagtcagtgtgacagccttttgcactcgcacccaagttctcgttcgacatctaggaggaatgaggtcacacaacaaattggaggtggtatatgtgggggattttattgccagtgaaagtggctctctgcagaaaggggagctgaaaaagggacagagcaggaaggtaatcttcccctgaagtccagccgtccctgctggactcctctcgaaagctacaacgtcaagccgtccggtgtccttataagaaaacagccttgctggttgcggtggctcacgcctgtaatcccagcactttgggaggcagagcaagagagagctaaggtggaggtgctgcacacttttaagtcaagctgcttctcctctctgccggctgagttctggggttactatagacacaagatgggggcagggcaggctgtgggtggttttggaaaaggcaacattccagcaggaaaacagggatgtaagttttcactttgggccgcggtattacgcttttcaccttgaggccggggccgtcgctggggacccaccctcttctgcccagaatttttctgcatcctgtccctgtcaatacggaataaaatggtacactgccatttcgcgttattcatttttttaaaaatacatatcctttaagctggttatttacctctttttaaaaggaaactgtaaggtcttccagggcagggagtatgtctgtaaagccttctagagctgggctccttgcttcctgatctcactctctcactgtctgtaggctcttgggcaggttatttaatttcttagtgtctcaatttcctcctctataaaacagagataatagtatttagcccagagggttgtggtgaagtgtgaatcatttctccatgtaaaacacataggacaggctgggcatggtggctcacgcctgtaatcccagcactttaggaggcctaggcgggtggatcacctgaggtcaggagttcaagaccagcctgggcaacatggagaaaccccatctctactgaaaatacaaaaattagctgtgcgtgatggcgcacacctgtaatcccagttactcgggagactgaggcaggagaatcacttgaacccgggagcggaggttgcggtgagccgagatcgtgccattgcacttaagcctgggttacaagagcgaaactctgtctcaaaacaaaacacacataggacagagctcagcacagagtagacattaaggattatatcctttgcttggcacaataccttgcacagggcaggcacgcaacagatgtctctggaatgaaggaatgaatgagtgaatgactgggttaagcatgttgccaccaggtggcagaagagcctcactatcaaggcagaacccaaacacgagactcatgagaactccctcctgaagtccagatacacattgaaaaaaaataaaaaaagcactgaaccccatttaggccttgaagtgaagttcctcttctctcttgcccttcctttctctcccatctctgctcactctctgctgtaatgaaccatttctttctttcccacttaatacatattagtcagtttgggctgccacagcaaaatactacagactcagtagtttaaacaacagatatttaatgcatcacagttctggaggttggaagtccatgatcaaagtgccatacgggctggtttctggtgaggcttctcttcctggcttgtagctgtccaccttcccactgttattctcacagggcctcttctctgtgccacacagagagaggaaggagagggagtgggagatggagagatgtcagattcacacaatgaagccctaaccgccattttgactgtatttgcaaatagggtttttttggtttgttttttgagacggagtcttgctctgtcgcccaggctggagtgcagtcgtgcaatctcggctcactgcaacctccgcctcctgggttcacgccattgtcctgtctcagcctcccaagtagctgggactgcaggcacccgccaccacactcagcaaattattttgtaatttagtagagatgggttttcaccatgttggtcaggctggtctcaaactcctgacctcgtgatccgcccgccttggcctcccaaagtgctgggattgcaggtgtgagccactgcaccgacctgcagatagggtttttagggagggagagagagagggagatctggagcgtcttcttataaggacaccagtcctatgggattaggccccacccaagttacctcatttaatcttaattacctccctaaagaccctgtctccaagtacagtcaaaccaggggttagggcttcattgtgtgaatctggaggggacactcttcagtttataacacgtacctttcattttttaattcctaattctcacacttcctaccaatgtggtttttcattcttactctcttgttattcccactcttcccccgacccccatccgccatccctcaatctttatatggcttttctagggctagttgtatttattgtaaactgaaaactccagggggcaccattcatgccatagtcagcataggtttgcatatgtattatgacaatgttgaggctgatggcagcaacatgtcttgaggaaggggagtctttttctcattcacacaaaggtgctggccccttcgttttcctctgttgttttcctgtcctcctccccatcattctctttcttcagcctttctctctctttccttactctcctcttcaggctgaacctgctccatgtccgtaaagagatgatttaattcatcgcaccacacattcatccagtaattttggtgggccaggccctttgtgggtgccagatggttcaccctattcttgcacctttaaaggaatcggtccatttacaccctagaggtcaatacccaatggaatgtgcctccaacatccttggatcattcatggtcttcatttaccttggagcagacattaagactcaagcattggccgggtgcggtggctcacgtctgtaataccagcactttgggaggccgatgtgggtggatcacaaggtcaggagttcaagaccagcctggccaacatggtgaaaccccatctctactaaaaatacaaaaattagctgggcatggtggcacgtgcctgtaatcccagctactcgagaggctgaggcaggagaattgcttgaactgggacctgggaggcggaggtagcagtgagctagatcgcgccattgcactccagcctgggctacagaatgagactctgtctcaaacacaaaaacaaacaaacaaaaaacaacaaaaagacaagactcaagcatggaggagaagagaagagaatataatccaataacataaactaatgtttattgaacacttgtgtgctgcacacagttctcatctctctctatgcatgacatttaatcatcaaaactgccttctcattttgtagatgagaaaactaagctgcagagaacgtggcagagactcctcctggtttcctaacttccattttcttttcctttatttaaataacaggagctcatgagttttggctgggcacatggctgcccaaggagagccgacatttcccagcctcccttgcagtttgatgtggccatataactgcattctagacacctgaggtgtgagtggaaatgatgtctgcaatttcagagttccatccttaaagggaagctgcttgcctctatgtcctcttttccttgtccccaggctgggacagggttaggggagtagtgaggcagctttgacaggagggtgaggacaggaagctggggaagagcagagcaaccactggaaggaagcttcacactcactccccacccactcactactcacccagagcaacttcccatcctgcaaactccaatcacgggaagtatcctatagaggggtatcctttttaaagaaaaaaaacctttgataccatatttttactgtactttttctacgtttgtatatgtttagatatacaaataccattgtgttgcaattacctacagtattcagtacagtaacgtgctgttcaggtttgcagcctagagcaataggctacaccatatagcctaggtgtatagtaggctataccatctaggtttgtgtaagtactgaacactccatgatgtttgcacaacggtcaaattgacaagtgacacatatcttggaacatatccctgttgttaagtgacacttgactgtatttctatttgggggaacagagcattgggaaagaaaacagaaggacccattgccttgaaggaaggatggtagacggaataatgtccaccctggcctcccaaagacgtccaagtcctaattcctggaaatatgagtatgttactttacttggcaaacgggactttgcagatgtgcttcaagtcaggaagttgagatggggagattgtcctggatgatttgggtggaccccatcaaatctcagggggctctctaagggaaagatgaaggtgggagcgtgagagccagataagacactgtgatgatggaagcagaggagagagagaagatgctacactgtgggccttaaagagagaagaaggggccctgatccgaagaatgcagcttctagaagctggaaaaggcaaggaaatggaatctgccctagaacctcactaggaatgaatcgcagctgacaccttgcttttagctaagttaaacccattttggacttctgacctccagacctataaaatactacacttgtgtttttttaagccatcaaatgtgtagtaatttgttagagaagcaataggaaataatagagagtgtgatagggtccctatggggaacgagtggcgcacatataggacataactgaccaaagtttaatgagacactgtgttttacagaggcttggccagggttaaaggcgaacaaacaggatgagaaatcaccaaggcattagcagcagcaacgagccagcacctccctgaggcttgaagggcaacgggaaaggaaaggtgttactagagaccagtgagaggagtcatggcagaggccacccaacagaagtagtggccacaaaggtgggactgtgggttgaacagatccccagaggtgtctgttatgcacagtaagctccaacagtgaaaaatcatttataaagggccgaggacagtggcttgcacctgcaatcccagcactttgggaggtcatggtgggcagattgcttaagcccaggagttccagaccagcctgggcaacatggcaaaacaccatctctactaaaaatttaaaaacttagttaggtgtggtggctggcacctgtagtcgcagctacttgggagggtgaggtaggcggatcacttgaacctgggaggttgaagctgcagtgagctgtaatcatgccactgcactccagcctggatgacagagcaagaccctgtctcaaaaaaaagaaaaaattatcaaggacttttgcctctaataaaatattcacagtggtttccttacttaatttctgaggtcaaaccagaaaatattagcagctgacttaattcaagaaggaggagcttgagtatacgtacttgttggtgtgtcttcaactcttgttctagattttactttgttttaaatatgtaaaaatgcttttagtgattacaacttatgcttcttatttcaacagatattttaaagggaaaaatatataattggatcacaggatataaaaagaaatgcagttatctatatgtgcaaaagcctagctaattgataaaagctataagttgagtcctgccactcaccttggggcaatgattttttatttatttattttattttattattattatttttttagacagagttgcccaggctggagtgcagtggtgcgatctgggctcactgcaacctccacctcccgggttcaagcaattctctgcctcagcctcccaagtagctgggattacagggtgcaccaccacacccagctaatttttgtatttatagtagacatggagtttcaccatcttggccaggatggttccgaactcctgacctcgtgatccaccactcggcctcccaaaatgctgggattacaagcataagccactgcaccacgcccggccaatgacccatttttttcaggcaaagtagcaatgggaaaatataaagtttctctagttttaatatagaagtggttaacctaatcacacaagccatacacagggtcatttgggagaatgtgcaaggaggattgcgtatttttatcttttcatagttttcttcttgataaataagcttctattttcaagccaaatctcatcttgcaatttcctgccaacttcacttctctacaaagtttacctttgcttttcccatctctgccctcaggcatttaacaaacactgtgccttttcatttttccagatttaagtgaaacattttgcagaaatgaggaatgtgataacagcccctgaagccctacctgacagcatgacattaatttgggcctgttttctctcatacttttcaattgctccccaatttatatttaatttgccacaggatataaaaagaaatatttctttaatttatattaaatacatctacattaggagagctagaggttatctaagtgaaactagctcgattatctaaaaaaagtcagaataaaataattataagcaaattggaagaacagccaacgttgttaccaataatttcttagagtttgttcaattattgtttgttatactctgtttccacttctttagccaaaataagctctaagcaaattcaaatctatttgtatagatgaagtctatgaatttaacatgataacttgaaaaaatgtaaaactttggctgggtgtggtggctcacacctgtaatcccagcactgtgggaggctgtggcgggcggatcacctaaggtcgggagctccagaccagcctggccaacattgtgaaaccccatctctactaaaaatacaagcattagcgaggcatggtggtgggcacctgtaatcccagctactcaggaggctgaggcaggagaatcgcttgaacccaggaggcggaggttgcagtgagccaagatcgtaccattgcattccagcctgggcaacaagagcaaaactccgtctcaaaaaaaaaaaaaattaaaacccaaataaattcatgtggatcttacccatatttcccatgatttagataggagttggttttaagtttatttttccactcaatgggggaaaggatttactaggaaaataatgtaaacaatctatttaagaagtcaaatggcttttaagcacttaaaaagctttgatattagcaatttacccataaatattttgttaattacataatttttttctttttaggaaatatttcttcttttcttcttcttttggctaagcctcagcagccaaattttttattttactttattttagtttactttttagagacagggcctccctctgtcacacacgctggagtgcagtggtatgatcatagctcactataaccacaaactcctgggctcaagccatcctccctcctcagcctcccgagtaggtgggactacaggtgtgcaccactacacccagctaatttttgtagtttttgtagagacggggtcttgtcatgttacccaggctggcctcgaactcctgggctcaagcaatcctccttcctcagcctcccaaaatgctgggattataggcgtgagccacagcaccagcctaccaggtatgcttttaatacatatatattgaataaataaacaaattaaagatcatctgacagaaccttcactggataatattattttttcttttcctttttttaaaaaataaggcagggtctcaccgtgttgcccaggcttgtcttgaacttctgggctcaagtgatcctcctgcttcggcctctcaaagtgctgagattacaggactgagccaccacaaccagccttcattggataacatgttatttgacatttcttctatcattgtacattgatgactgttggttgcctgcccagcagccattgcccccattactcctgttagaataaccctgattttgtgtttgtcattttattttattttatagacaaggtctcactccatcacccaggctgcaatgcaatgtagtgatcatagctcactgcaacctggaacgtctgggctcaagtgatcctcccacttcagactcctgagtagctgggactacaggtgtgcaccaccatgccaggctaattattttattttttgcagagatggaatctcacttcatttcccaggctggtcttgaactcctggactcaagccatcctcccgtttcagcccctcaagcactgggattacaggagtgagcccaccacacctggcagcgtccatcttttaaaaacttgattcagggaagggggcatcctattcctgctagagggcaaaatcgtggttgatgtaaggtagtgattttcaactggaggtaattcggcaatattttgcagtttttgttgccacagaggtaagcatattgtgctactggcatctagcgggtagagggcaggggtgcggctaaacattcttcaatgcacaggacagcccccacaacaaagagaaccatccagtccaaaatgtcaatggtgctgaggttgagaaccctgacctaaaccagtcctggtggtctcattccctagctgttagtggtttagatcccatgatgttaagtaattctgaccaatgagacgtgagcagaaattgacaagaggagtatggcagagaatgttaatttctccctacattcactttacctttcttttcagcagaagttacattcagtgttagctaggcgcatgcccaattacagactataattcccagcctccatcgttgcaaggtgtggccaagttttggctaatgggatgtgagaaaaaaataatgagtctaatttctagaccatgtttttaagaaggagaatgcttgttctttactttctctcttaatccctttctgcacactgggtggtactgctaatccagcttcaagcaagcacatgactccagagaatggcagagcaagacagaaagacttacatacattgggactgatacatgaaaagaaaataaattgctttcttctttgaaccatcgtattttttagtttttttgttttagcagtttaagctgtatgtatatgaggtactcctggggaaggttttttcctctgtgatcacacacacacatacacacacacacacacacacacacacggagggaatattcatctaaaggatgttgtaggatttgtgtgagatggctggaaccatggctgctatcttgtgaccatgaggggaggtacctggtggttcaaaactgccctgctaagtgagaacggaataggaaggttgtaaacagcccaaatctttcttaaccttgttaagccattgagttgacgaactttgcatctgtcctgtctcaggacttcttgttaagcaagatggtatatttttcatatcgtttaaatatttggcctttaaattttcagtaatagtccttacagtgatggctttcagacagaaaattaaaaattttaaaaagtgctatcctaactgattctctcaatgtattcaagtgtaaagaaattacatgtctaacctctcatggaattagagggaaaaaatttcatgttattttaagtatgttcagttcttttattaactcatattggtttcccccctactccttacccttgcaaccaagataatttgcatctaagaggttttattctgtttccactgatatgtttagaaattactatatctgaggtgggtatattgggaaaacatacactaccactcctttgcagaaatgagggcttattgcagcagctactcgcccttgcaatgcttcctgcttggaaactcgaaggactacattgagcaggtggaataaagttgaatcgaaggttcaacttacaagcagtcaggaggaggtctgccctgaagcactgtgcagactgggacctgcagcagggctgggagggggagtgtcgaggaaatgccttttgcatgtcaatggagccccgttgctgttctgtgctgcacagccacatgaggtcatcccagattagagggtgcccatgtccaggatcttaaaccaattacttccatctccattgcttcctctaaagcctcactcttagttctacacagtaatactgcctggaaactccccaaggccaccaagctcatactaacaggtttgtgatgtgggcaaactccttacatgatctcaaaatgaaagaagaggctgttcactggaggcaatagcaaatcccctttgttcctctcttggcagatgagggccttcgctctctccctaagggttccgcctgtcaccatctgtgcacccactgtggaagggccagcgctaaggtgaatttccatttacttcctgccagcagatggctcctccttttggtctcatcttgaattgtttgccagaccagccaattagtctcctcacccttcctgaagcgtcccagggaagcaatatcatcaccagcagcctatcattataccacgtcttctaagcaccgtgattctaaatgcctgccgtggaacagaagctcattcgcacatggctctttaacccttccttgaaagacctcaattcaacattctctctctcgctcacacacacacacacacacacacaaatgcacactcacacacagtacctacaacctgatccaagataggaaacaaaatgacagtatgcggcattcaataataaatttaaaaataagacataatttcagacagaatgcagaaggaaaaacacagtaactatattttctgatccccactgaggacacaataaaaacttttttttaggccaggcacggtggctcacgtgtgtaaccccagcactgtgggaggccgaggcgggcggatcacgaggtcaggaggttgagaccatcctgactaacatggtgaaaccctgtctctactaaaaatacaaaaattagcctgacgtagtggcgtgtgcctgtaatcccagctacttgggaggctgaggcaggagaatctcttgaaccagggagttagaggttgaaatgagccgagatcgcaccactgcactccagcctggcgacagagcaagactccatcacaaaaaaaataatgatacaaaaaaattaattaaataaataaaaattaaaaataaaaaaaagtggagggtttttttttttttttttttttgacagagtcttgctctgtcgccaggctggagtgcagtggcgcaatctcggctcactgcaacctccaactctctggttcaagagattctcctgcctcagcctcccgagtagctgggattacaggcacacactaccacgtcctgctaatttttgtatttttagtagagtcgggttttaccatgttggccaggctggtcttgatctcctgacctcgtgatcctcccacctcagcctcctaaagttctgggattacgggaatgagccactgcatccggccaaaactttttttttttttaccttgtggatttgttcatatgaaagaaatcttttaaggatataaaatcaaattgcactgagttacatttaacaaagtatctttatcagaaaagagtatatagaatgacactggcaggattcttcatccccgcaacccaggatgaatgatgactttccaggctaggccaaggagattctcccagcgctattcttagaaacatcaacaaggcccttgtgcacttgttttagggtttttcatcttcagacattcctgcctgatgcctaaagaagacatattattcagggcatcccatttgaatactgtatctgctctgatgcttgagcaaagtgtctgtaaagctagacagaggggacaactgcttccatccatggggcaagggagcaatgatgagatgatggaggttaaagatatttgtgaggcagacacagcatctgtgcagaggggtagaggtatttgtttttccacttttctgctcttgttaccctaacttccttgtgttctgtgattattgcacatgagctggagtagcaggggaggttcagttccttttggtggttgaggtggcaggtaaggaggcatggacacaggacgaaccccacttttgggcaaccgccaccctgaggcaagggtgggaaaagctcactttcccataaataatcactgggctgttgtccttcagtataagtgaatataagcaaagccccaagaacagtgcctggcacataaaatgcagtagctcagggtgggctataaccacttgcatcttctacagcagtgccttgtgccagcatgccctcaataaacatttgttcagtgaaggactgtacagctctgtgccacctggcagctccaactgtcccagtggatcttcctcttcctttgttcttttccttgcaaactttgcaataaagggggcattggcccaacagttaactcccaaatcttgaacaaagaggattacccctgcaactctgttccaaactgggaagcttctggctttgtggtgagctagggactgctgaaaacaactagagattaaaagaagctggaaccagctggagaataaagaaaactgctgcaagcaagtcactgcaggaagtaccagtggtctccaaaaatgcagttgcaccagattttacatacaataaggaggattggtctctctagacaggagagagtcaagtgttcctctgagaaggaaccaactcctgtaaatcaggaaatctcaggctctcactggccaaggggcaatgggacacctccccaaggtgattcatcggctccctctgaacccagaagctcaagcccattgtgctcctttttgtagactcttctcttaccctagtccccaagaatgtgctctgtgagcaggttacacccttcacaagaccctttcatgccctgtgactcccttccccattgtttgcatagtctggcagcttctgccactttccctggtaagccctgccttaaagtgaaccctcttctgtcaatcaccaggg

SEQ ID NO: 719 - DNA, 2060 bp, Homo sapiens
ctctatcgacgagtctggtagctgagcgttgggctgtaggtcgctgtgctgtgtgatcccccagagccatgcccgagatagtggatacctgttcgttggcctctccggcttccgtctgccggaccaagcacctgcacctgcgctgcagcgtcgactttactcgccggacgctgaccgggactgctgctctcacggtccagtctcaggaggacaatctgcgcagcctggttttggatacaaaggaccttacaatagaaaaagtagtgatcaatggacaagaagtcaaatatgctcttggagaaagacaaagttacaagggatcgccaatggaaatctctcttcctatcgctttgagcaaaaatcaagaaattgttatagaaatttcttttgagacctctccaaaatcttctgctctccagtggctcactcctgaacagacttctgggaaggaacacccatatctctttagtcagtgccaggccatccactgcagagcaatccttccttgtcaggacactccttctgtgaaattaacctatactgcagaggtgtctgtccctaaagaactggtggcacttatgagtgctattcgtgatggagaaacacctgacccagaagacccaagcaggaaaatatacaaattcatccaaaaagttccaataccctgctacctgattgctttagttgttggagctttagaaagcaggcaaattggcccaagaactttggtgtggtctgagaaagagcaggtggaaaagtctgcttatgagttttctgagactgaatctatgcttaaaatagcagaagatctgggaggaccgtatgtatggggacagtatgacctattggtcctgccaccatccttcccttatggtggcatggagaatccttgccttacttttgtaactcctactctactggcaggcgacaagtcactctccaatgtcattgcacatgaaatatctcatagctggacagggaatctagtgaccaacaaaacttgggatcacttttggttaaatgagggacatactgtgtacttggaacgccacatttgcggacgattgtttggtgaaaagttcagacattttaatgctctgggaggatggggagaactacagaattcggtaaagacatttggggagacacatcctttcaccaaacttgtggttgatctgacagatatagaccctgatgtagcttattcttcagttccctatgagaagggctttgctttacttttttaccttgaacaactgcttggaggaccagagattttcctaggattcttaaaagcttatgttgagaagttttcctataagagcataactactgatgactggaaggatttcctgtattcctattttaaagataaggttgatgttctcaatcaagttgattggaatgcctggctctactctcctggactgcctcccataaagcccaattatgatatgactctgacaaatgcttgtattgccttaagtcaaagatggattactgccaaagaagatgatttaaattcattcaatgccacagacctgaaggatctctcttctcatcaattgaatgagtttttagcacagacgctccagagggcacctcttccattggggcacataaagcgaatgcaagaggtgtacaacttcaatgccattaacaattctgaaatacgattcagatggctgcggctctgcattcaatccaagtgggaggacgcaattcctttggcgctaaagatggcaactgaacaaggaagaatgaagtttacccggcccttattcaaggatcttgctgcctttgacaaatcccatgatcaagctgtccgaacctaccaagagcacaaagcaagcatgcatcccgtgactgcaatgctggtggggaaagacttaaaagtggattaaagacctgcgtattgatgattttagagatttctcttttttaaatggaattcgtaaagaaatataaaacttcagctcacaattaaaactgtctttttagttttggctttttattgttttgttggtgattttactgaaataaagatgagctacttcttc

SEQ ID NO: 720 - protein, 601 aa, Homo sapiens
MPEIVDTCSLDASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFKYFKDKVDVLNQVDWNAWKPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFWLFKDLAAFDKSHDQAVRTYQEHKASMHPVTAMLVGKDLKVD

SEQ ID NO: 721 - DNA, 20 bp, Artificial sequence
  Synthetic primer
ggaaggaggacacttctgga

SEQ ID NO: 722 - DNA, 21 bp, Artificial sequence
  Synthetic primer
gctgtgaatggctaaacttgg

SEQ ID NO: 723 - DNA, 20 bp, Artificial sequence
  Synthetic primer
cacagaagctgcagtggaag

SEQ ID NO: 724 - DNA, 21 bp, Artificial sequence
  Synthetic primer
caaatggaggagtcaagacca

SEQ ID NO: 725 - DNA, 26 bp, Artificial sequence
  Synthetic primer
gcagtttaagctgtatgtatatgagg

SEQ ID NO: 726 - DNA, 21 bp, Artificial sequence
  Synthetic primer
tgaaagccatcactgtaagga

SEQ ID NO: 727 - DNA, 26 bp, Artificial sequence
  Synthetic primer
gcagtttaagctgtatgtatatgagg

SEQ ID NO: 728 - DNA, 21 bp, Artificial sequence
  Synthetic primer
tgaaagccatcactgtaagga

SEQ ID NO: 729 - DNA, 20 bp, Artificial sequence
  Synthetic primer
ggaaggaggacacttctgga

SEQ ID NO: 730 - DNA, 21 bp, Artificial sequence
  Synthetic primer
gctgtgaatggctaaacttgg

What is claimed is:

1. A method of detecting an LTA4H haplotype associated with myocardial infarction (MI) risk in a human individual and assessing susceptibility to MI in said human individual, comprising assaying a nucleic acid-containing sample obtained from the human individual to detect therein the presence of an LTA4H haplotype associated with MI risk, wherein the LTA4H haplotype comprises polymorphisms SG12S16 having allele C, SG12S21 having allele G, SG12S23 having allele T, SG12S25 having allele A, SG12S26 having allele T, SG12S100 having allele T, SG12S28 having allele T, SG12S143 having allele C, SG12S144 having allele G, and SG12S221 having allele G, wherein the presence of the LTA4H haplotype in the nucleic acid-containing sample identifies the individual as having elevated susceptibility to MI.

* * * * *